United States Patent
Ader et al.

(10) Patent No.: US 10,829,828 B2
(45) Date of Patent: *Nov. 10, 2020

(54) METHODS AND COMPOSITIONS FOR WEED CONTROL

(71) Applicant: Monsanto Technology LLC, St. Louis, MO (US)

(72) Inventors: Daniel Ader, St. Louis, MO (US); Matthew W. Dimmic, Wildwood, MO (US); Zhaolong Li, St. Charles, MO (US); Robert Douglas Sammons, Wentzville, MO (US); Ronak Hasmukh Shah, Jamaica, NY (US); Nengbing Tao, O'Fallon, MO (US); Dafu Wang, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 14 days.

This patent is subject to a terminal disclaimer.

(21) Appl. No.: 15/228,465

(22) Filed: Aug. 4, 2016

(65) Prior Publication Data

US 2016/0330965 A1  Nov. 17, 2016

Related U.S. Application Data

(63) Continuation-in-part of application No. 13/612,941, filed on Sep. 13, 2012, now Pat. No. 9,422,557.

(60) Provisional application No. 61/534,073, filed on Sep. 13, 2011.

(51) Int. Cl.
| | |
|---|---|
| C12N 15/82 | (2006.01) |
| C12N 9/00 | (2006.01) |
| A01N 65/00 | (2009.01) |
| A01H 3/04 | (2006.01) |

(52) U.S. Cl.
CPC ........ *C12Y 604/01002* (2013.01); *A01H 3/04* (2013.01); *A01N 65/00* (2013.01); *C12N 9/93* (2013.01); *C12N 15/8218* (2013.01); *C12N 15/8247* (2013.01); *C12N 15/8274* (2013.01)

(58) Field of Classification Search
CPC ............ C12N 2310/14; C12N 15/8218; C12N 15/8274; C12Y 604/01002
See application file for complete search history.

(56) References Cited

U.S. PATENT DOCUMENTS

| | | |
|---|---|---|
| 3,687,808 A | 8/1972 | Merigan et al. |
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,469,863 A | 9/1984 | Ts'o et al. |
| 4,476,301 A | 10/1984 | Imbach et al. |
| 4,535,060 A | 8/1985 | Comai |
| 4,581,847 A | 4/1986 | Hibberd et al. |
| 4,666,828 A | 5/1987 | Gusella |
| 4,683,202 A | 7/1987 | Mullis |
| 4,761,373 A | 8/1988 | Anderson et al. |
| 4,769,061 A | 9/1988 | Comai |
| 4,801,531 A | 1/1989 | Frossard |
| 4,810,648 A | 3/1989 | Stalker |
| 4,879,219 A | 11/1989 | Wands et al. |
| 4,940,835 A | 7/1990 | Shah et al. |
| 4,971,908 A | 11/1990 | Kishore et al. |
| 5,004,863 A | 4/1991 | Umbeck |
| 5,011,771 A | 4/1991 | Bellet et al. |
| 5,013,659 A | 5/1991 | Bedbrook et al. |
| 5,015,580 A | 5/1991 | Christou et al. |
| 5,023,243 A | 6/1991 | Tullis |
| 5,034,506 A | 7/1991 | Summerton et al. |
| 5,094,945 A | 3/1992 | Comai |
| 5,141,870 A | 8/1992 | Bedbrook et al. |
| 5,145,783 A | 9/1992 | Kishore et al. |
| 5,159,135 A | 10/1992 | Umbeck |
| 5,166,315 A | 11/1992 | Summerton et al. |
| 5,177,196 A | 1/1993 | Meyer, Jr. et al. |
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |

(Continued)

FOREIGN PATENT DOCUMENTS

| | | |
|---|---|---|
| AU | 2008258254 B2 | 7/2014 |
| AU | 20 14262189 B2 | 11/2014 |

(Continued)

OTHER PUBLICATIONS

Wang, C. J., and Z. Q. Liu. "Foliar uptake of pesticides—present status and future challenge." Pesticide Biochemistry and Physiology 87.1 (2007): 1-8. (Year: 2007).*

(Continued)

*Primary Examiner* — Weihua Fan

(74) *Attorney, Agent, or Firm* — Arnold & Porter Kaye Scholer LLP; Amanda Carmany-Rampey; David R. Marsh

(57) ABSTRACT

The present invention provides novel compositions for use to enhance weed control. Specifically, the present invention provides for methods and compositions that modulate Acetyl-CoA carboxylase in weed species. The present invention also provides for combinations of compositions and methods that enhance weed control.

20 Claims, 1 Drawing Sheet

Specification includes a Sequence Listing.

(56) References Cited

U.S. PATENT DOCUMENTS

| | | |
|---|---|---|
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |
| 5,276,019 A | 1/1994 | Cohen et al. |
| 5,281,521 A | 1/1994 | Trojanowski et al. |
| 5,286,634 A | 2/1994 | Stadler et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,384,253 A | 1/1995 | Krzyzek et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,459,127 A | 10/1995 | Felgner et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Häberlein et al. |
| 5,558,071 A | 9/1996 | Ward et al. |
| 5,561,225 A | 10/1996 | Maddry et al. |
| 5,561,236 A | 10/1996 | Leeman et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,597,717 A | 1/1997 | Guerineau et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,719,046 A | 2/1998 | Guerineau et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A * | 11/1999 | Sandbrink .............. A01N 43/40 504/363 |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |
| 6,232,526 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Boukens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,479,291 B2 | 11/2002 | Kumagai et al. |
| 6,506,559 B1 | 1/2003 | Fire et al. |
| 6,506,599 B1 | 1/2003 | Yoon |
| 6,642,435 B1 | 11/2003 | Rafalski et al. |
| 6,644,341 B1 | 11/2003 | Chemo et al. |
| 6,645,914 B1 | 11/2003 | Woznica et al. |
| 6,768,044 B1 | 7/2004 | Boudec et al. |
| 6,992,237 B1 | 1/2006 | Habben et al. |
| 7,022,896 B1 | 4/2006 | Weeks et al. |
| 7,026,528 B2 | 4/2006 | Cheng et al. |
| RE39,247 E | 8/2006 | Barry et al. |
| 7,105,724 B2 | 9/2006 | Weeks et al. |
| 7,119,256 B2 | 10/2006 | Shimizu et al. |

(56) References Cited

U.S. PATENT DOCUMENTS

| | | |
|---|---|---|
| 7,138,564 B2 | 11/2006 | Tian et al. |
| 7,297,541 B2 | 11/2007 | Moshiri et al. |
| 7,304,209 B2 | 12/2007 | Zink et al. |
| 7,312,379 B2 | 12/2007 | Andrews et al. |
| 7,323,310 B2 | 1/2008 | Peters et al. |
| 7,371,927 B2 | 5/2008 | Yao et al. |
| 7,392,379 B2 | 6/2008 | Le Pennec et al. |
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,884,262 B2 | 2/2011 | Clemente et al. |
| 7,910,805 B2 | 3/2011 | Duck et al. |
| 7,935,869 B2 | 5/2011 | Palled et al. |
| 7,943,819 B2 | 5/2011 | Baum et al. |
| 7,973,218 B2 | 7/2011 | McCutchen et al. |
| 8,090,164 B2 | 1/2012 | Bullitt et al. |
| 8,143,480 B2 | 3/2012 | Axtell et al. |
| 8,226,938 B1 | 7/2012 | Meikle et al. |
| 8,548,778 B1 | 10/2013 | Hart et al. |
| 8,554,490 B2 | 10/2013 | Tang et al. |
| 9,121,022 B2 | 9/2015 | Sammons et al. |
| 9,422,557 B2 | 8/2016 | Ader |
| 9,445,603 B2 | 9/2016 | Baum et al. |
| 9,777,288 B2 | 10/2017 | Beattie et al. |
| 9,850,496 B2 | 12/2017 | Beattie et al. |
| 9,856,495 B2 | 1/2018 | Beattie et al. |
| 9,957,523 B2 | 5/2018 | Raemaekers et al. |
| 2001/0006797 A1 | 7/2001 | Kumagai et al. |
| 2001/0042257 A1 | 11/2001 | Connor-Ward et al. |
| 2002/0069430 A1 | 6/2002 | Kisaka et al. |
| 2002/0106653 A1 | 8/2002 | Kurane et al. |
| 2002/0114784 A1 | 8/2002 | Li et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2003/0221211 A1 | 11/2003 | Rottmann et al. |
| 2004/0029275 A1 | 2/2004 | Brown et al. |
| 2004/0053289 A1 | 3/2004 | Allen et al. |
| 2004/0055041 A1 | 3/2004 | Labate et al. |
| 2004/0072692 A1 | 4/2004 | Hoffman et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cai et al. |
| 2004/0250310 A1 | 12/2004 | Shukla et al. |
| 2005/0005319 A1 | 1/2005 | della-Cioppa et al. |
| 2005/0044591 A1* | 2/2005 | Yao .................. C12N 9/90 800/287 |
| 2005/0215435 A1 | 9/2005 | Menges et al. |
| 2005/0223425 A1 | 10/2005 | Clinton et al. |
| 2005/0246784 A1 | 11/2005 | Plesch et al. |
| 2005/0250647 A1 | 11/2005 | Hills et al. |
| 2005/0289664 A1 | 12/2005 | Moshiri et al. |
| 2006/0009358 A1 | 1/2006 | Kibler et al. |
| 2006/0021087 A1 | 1/2006 | Baum et al. |
| 2006/0040826 A1 | 2/2006 | Eaton et al. |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffman et al. |
| 2006/0223709 A1 | 10/2006 | Helmke et al. |
| 2006/0247197 A1 | 11/2006 | Van De Craen et al. |
| 2006/0272049 A1 | 11/2006 | Waterhouse et al. |
| 2006/0276339 A1 | 12/2006 | Windsor et al. |
| 2007/0011775 A1 | 1/2007 | Allen et al. |
| 2007/0021360 A1 | 1/2007 | Nyce et al. |
| 2007/0050863 A1 | 3/2007 | Tranel et al. |
| 2007/0124836 A1 | 5/2007 | Baum et al. |
| 2007/0199095 A1 | 8/2007 | Allen et al. |
| 2007/0250947 A1 | 10/2007 | Boukharov et al. |
| 2007/0259785 A1 | 11/2007 | Heck et al. |
| 2007/0269815 A1 | 11/2007 | Rivory et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0113351 A1 | 5/2008 | Naito et al. |
| 2008/0155716 A1 | 6/2008 | Sonnewald et al. |
| 2008/0214443 A1 | 9/2008 | Baum et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0075921 A1 | 3/2009 | Ikegawa et al. |
| 2009/0094717 A1 | 4/2009 | Troukhan et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0144848 A1 | 6/2009 | Kovalic et al. |
| 2009/0165153 A1 | 6/2009 | Wang et al. |
| 2009/0165166 A1 | 6/2009 | Feng et al. |
| 2009/0172838 A1 | 7/2009 | Axtell et al. |
| 2009/0188005 A1 | 7/2009 | Boukharov et al. |
| 2009/0205079 A1 | 8/2009 | Kumar et al. |
| 2009/0215628 A1 | 8/2009 | Witschel et al. |
| 2009/0285784 A1 | 11/2009 | Raemaekers et al. |
| 2009/0293148 A1 | 11/2009 | Ren et al. |
| 2009/0298787 A1 | 12/2009 | Raemaekers et al. |
| 2009/0306189 A1 | 12/2009 | Raemaekers et al. |
| 2009/0307803 A1 | 12/2009 | Baum et al. |
| 2010/0005551 A1 | 1/2010 | Roberts et al. |
| 2010/0048670 A1 | 2/2010 | Biard et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0192237 A1 | 7/2010 | Ren et al. |
| 2010/0247578 A1 | 9/2010 | Salama |
| 2010/0248373 A1 | 9/2010 | Baba et al. |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 | 2/2011 | Eudes et al. |
| 2011/0041400 A1 | 2/2011 | Trias Vila et al. |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |
| 2011/0152353 A1 | 6/2011 | Koizumi et al. |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Force et al. |
| 2011/0201501 A1 | 8/2011 | Song et al. |

(56) References Cited

U.S. PATENT DOCUMENTS

| | | |
|---|---|---|
| 2011/0203013 A1 | 8/2011 | Peterson et al. |
| 2011/0296555 A1 | 12/2011 | Ivashuta et al. |
| 2011/0296556 A1 | 12/2011 | Sammons et al. |
| 2012/0036594 A1 | 2/2012 | Cardoza et al. |
| 2012/0107355 A1 | 5/2012 | Harris et al. |
| 2012/0108497 A1 | 5/2012 | Paldi et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0157512 A1 | 6/2012 | Ben-Chanoch et al. |
| 2012/0164205 A1 | 6/2012 | Baum et al. |
| 2012/0174262 A1 | 7/2012 | Azhakanandam et al. |
| 2012/0185967 A1 | 7/2012 | Sela et al. |
| 2012/0198586 A1 | 8/2012 | Narva et al. |
| 2012/0230565 A1 | 9/2012 | Steinberg et al. |
| 2012/0258646 A1 | 10/2012 | Sela et al. |
| 2013/0003213 A1 | 1/2013 | Kabelac et al. |
| 2013/0041004 A1 | 2/2013 | Drager et al. |
| 2013/0047297 A1 | 2/2013 | Sammons et al. |
| 2013/0047298 A1 | 2/2013 | Tang |
| 2013/0060133 A1 | 3/2013 | Kassab et al. |
| 2013/0067618 A1 | 3/2013 | Ader et al. |
| 2013/0084243 A1 | 4/2013 | Goetsch et al. |
| 2013/0096073 A1 | 4/2013 | Sidelman |
| 2013/0097726 A1 | 4/2013 | Ader et al. |
| 2013/0212739 A1 | 8/2013 | Giritch et al. |
| 2013/0226003 A1 | 8/2013 | Edic et al. |
| 2013/0247247 A1 | 9/2013 | Ader et al. |
| 2013/0254940 A1 | 9/2013 | Ader et al. |
| 2013/0254941 A1 | 9/2013 | Ader et al. |
| 2013/0288895 A1 | 10/2013 | Ader et al. |
| 2013/0318657 A1 | 11/2013 | Avniel et al. |
| 2013/0318658 A1 | 11/2013 | Ader et al. |
| 2013/0324842 A1 | 12/2013 | Mittal et al. |
| 2013/0326731 A1 | 12/2013 | Ader et al. |
| 2014/0018241 A1 | 1/2014 | Sammons et al. |
| 2014/0057789 A1 | 2/2014 | Sammons et al. |
| 2014/0109258 A1 | 4/2014 | Van De Craen et al. |
| 2014/0230090 A1 | 8/2014 | Avniel et al. |
| 2014/0274712 A1 | 9/2014 | Finnessy et al. |
| 2014/0275208 A1 | 9/2014 | Hu et al. |
| 2014/0296503 A1 | 10/2014 | Avniel et al. |
| 2015/0096079 A1 | 4/2015 | Avniel et al. |
| 2015/0143580 A1 | 5/2015 | Beattie et al. |
| 2015/0159156 A1 | 6/2015 | Inberg et al. |
| 2015/0203867 A1 | 7/2015 | Beattie et al. |
| 2015/0240258 A1 | 8/2015 | Beattie et al. |
| 2016/0015035 A1 | 1/2016 | Tao |
| 2016/0029644 A1 | 2/2016 | Tao |

FOREIGN PATENT DOCUMENTS

| | | | |
|---|---|---|---|
| CN | 101279950 A | | 10/2008 |
| CN | 101279951 A | | 10/2008 |
| CN | 101892247 A | | 11/2010 |
| CN | 101914540 A | * | 12/2010 |
| CN | 101914540 A | | 12/2010 |
| CN | 102154364 A | | 8/2011 |
| CN | 102481311 A | | 5/2012 |
| CN | 102822350 A | | 12/2012 |
| CN | 102906263 A | | 1/2013 |
| DE | 288618 A5 | | 4/1991 |
| DE | 10000600 A1 | | 7/2001 |
| DE | 10116399 A1 | | 10/2002 |
| DE | 10256353 A1 | | 6/2003 |
| DE | 10256354 A1 | | 6/2003 |
| DE | 10256367 A1 | | 6/2003 |
| DE | 10204951 A1 | | 8/2003 |
| DE | 10234875 A1 | | 2/2004 |
| DE | 10234876 A1 | | 2/2004 |
| DE | 102004054666 A1 | | 5/2006 |
| DE | 102005014638 A1 | | 10/2006 |
| DE | 102005014906 A1 | | 10/2006 |
| DE | 102007012168 A1 | | 9/2008 |
| DE | 102010042866 A1 | | 5/2011 |
| EP | 0 804 600 A1 | | 11/1997 |
| EP | 1 155 615 A1 | | 11/2001 |
| EP | 1 157 991 A2 | | 11/2001 |
| EP | 1 238 586 A1 | | 9/2002 |
| EP | 1 416 049 A1 | | 5/2004 |
| EP | 1 496 123 A1 | | 1/2005 |
| EP | 1 889 902 A1 | | 2/2008 |
| EP | 1 964 919 A1 | | 9/2008 |
| EP | 2 147 919 A1 | | 1/2010 |
| EP | 2 160 098 B1 | | 11/2010 |
| EP | 2 530 159 A1 | | 3/2011 |
| EP | 2 305 813 A2 | | 4/2011 |
| EP | 2 473 024 A2 | | 7/2012 |
| EP | 2 545 182 A1 | | 1/2013 |
| JP | 2001253874 A | | 9/2001 |
| JP | 2002080454 A | | 3/2002 |
| JP | 2002138075 A | | 5/2002 |
| JP | 2002145707 A | | 5/2002 |
| JP | 2002220389 A | | 8/2002 |
| JP | 2003064059 A | | 3/2003 |
| JP | 2003096059 A | | 4/2003 |
| JP | 2004051628 A | | 2/2004 |
| JP | 2004107228 A | | 4/2004 |
| JP | 2005008583 A | | 1/2005 |
| JP | 2005239675 A | | 9/2005 |
| JP | 2005314407 A | | 11/2005 |
| JP | 2006232824 A | | 9/2006 |
| JP | 2006282552 A | | 10/2006 |
| JP | 2007153847 A | | 6/2007 |
| JP | 2007161701 A | | 6/2007 |
| JP | 2007182404 A | | 7/2007 |
| JP | 2008074840 A | | 4/2008 |
| JP | 2008074841 A | | 4/2008 |
| JP | 2008133207 A | | 6/2008 |
| JP | 2008133218 A | | 6/2008 |
| JP | 2008169121 A | | 7/2008 |
| JP | 2009-508481 A | | 3/2009 |
| JP | 2009067739 A | | 4/2009 |
| JP | 2009114128 A | | 5/2009 |
| JP | 2009126792 A | | 6/2009 |
| JP | 2009137851 A | | 6/2009 |
| JP | 2016-532440 A | | 10/2015 |
| RU | 2 291 613 C1 | | 1/2007 |
| RU | 2 337 529 C1 | | 11/2008 |
| WO | WO 89/11789 A1 | | 12/1989 |
| WO | WO 95/34659 A1 | | 12/1995 |
| WO | WO 95/34668 A2 | | 12/1995 |
| WO | WO 96/005721 A1 | | 2/1996 |
| WO | WO 96/033270 A1 | | 10/1996 |
| WO | WO 96/038567 A2 | | 12/1996 |
| WO | WO 96/040964 A2 | | 12/1996 |
| WO | WO 97/49816 A1 | | 12/1997 |
| WO | WO 99/14348 A1 | | 3/1999 |
| WO | WO 99/024585 A1 | | 5/1999 |
| WO | WO 99/26467 A1 | | 6/1999 |
| WO | WO 99/27116 A2 | | 6/1999 |
| WO | WO 99/32619 A1 | | 7/1999 |
| WO | WO 99/61631 A1 | | 12/1999 |
| WO | WO 99/67367 A1 | | 12/1999 |
| WO | WO1999/67367 | * | 12/1999 ............... C12N 9/00 |
| WO | WO-1999067367 A1 | * | 12/1999 ............. C12N 15/82 |
| WO | WO 00/32757 A2 | | 6/2000 |
| WO | WO 00/044914 A1 | | 8/2000 |
| WO | WO 01/07601 A2 | | 2/2001 |
| WO | WO 2001/007601 A2 | | 2/2001 |
| WO | WO 2001/085970 A2 | | 11/2001 |
| WO | WO 02/14472 A2 | | 2/2002 |
| WO | WO 02/066660 A2 | | 8/2002 |
| WO | WO 03/000679 A2 | | 1/2003 |
| WO | WO 03/004649 | | 1/2003 |
| WO | WO 03/006422 A1 | | 1/2003 |
| WO | WO 2003/004649 | | 1/2003 |
| WO | WO 03/012052 A2 | | 2/2003 |
| WO | WO 03/013247 A1 | | 2/2003 |
| WO | WO 03/016308 A1 | | 2/2003 |
| WO | WO 2003/014357 A1 | | 2/2003 |
| WO | WO 03/020704 A1 | | 3/2003 |
| WO | WO 03/022051 A1 | | 3/2003 |
| WO | WO 03/022831 A1 | | 3/2003 |

(56) References Cited

FOREIGN PATENT DOCUMENTS

| | | |
|---|---|---|
| WO | WO 03/022843 A1 | 3/2003 |
| WO | WO 03/029243 A2 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/064625 A2 | 8/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A2 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/007860 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |
| WO | WO 2005/107437 A2 | 11/2005 |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/132270 A1 | 12/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/038788 A2 | 4/2007 |
| WO | WO 2007/039454 A1 | 4/2007 |
| WO | WO 2007/050715 A2 | 5/2007 |
| WO | WO 2007/051462 A2 | 5/2007 |
| WO | WO 2007/070389 A2 | 6/2007 |
| WO | WO 2007/071900 A1 | 6/2007 |
| WO | WO 2007/074405 A2 | 7/2007 |
| WO | WO 2007/077201 A1 | 7/2007 |
| WO | WO 2007/077247 A1 | 7/2007 |
| WO | WO 2007/080126 A2 | 7/2007 |
| WO | WO 2007/080127 A2 | 7/2007 |
| WO | WO 2007/083193 A2 | 7/2007 |
| WO | WO 2007/096576 A1 | 8/2007 |
| WO | WO 2007/051462 A3 | 10/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/029690 A1 | 3/2009 |
| WO | WO 2009/035150 A2 | 3/2009 |
| WO | WO 2009/037329 A2 | 3/2009 |
| WO | WO 2009/046384 A1 | 4/2009 |
| WO | WO 2009/060429 A2 | 5/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090401 A2 | 7/2009 |
| WO | WO 2009/090402 A2 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/144079 A2 | 12/2009 |
| WO | WO 2009/152995 A1 | 12/2009 |
| WO | WO 2009/153607 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |
| WO | WO 2010/049414 A1 | 5/2010 |
| WO | WO 2010/056519 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/093788 A2 | 8/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/130970 A1 | 11/2010 |
| WO | WO 2011/001434 A1 | 1/2011 |
| WO | WO 2011/003776 A2 | 1/2011 |
| WO | WO 2011/028836 A2 | 3/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |
| WO | WO 2011/075188 A1 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |
| WO | WO 2012/156342 A1 | 11/2012 |
| WO | WO 2012/164100 A2 | 12/2012 |
| WO | WO 2013/010691 A1 | 1/2013 |
| WO | WO 2013/025670 A1 | 2/2013 |

(56) References Cited

FOREIGN PATENT DOCUMENTS

| WO | WO 2013/039990 A1 | 3/2013 |
|---|---|---|
| WO | WO 2013/040005 A1 | 3/2013 |
| WO | WO 2013/040021 A1 | 3/2013 |
| WO | WO 2013/040033 A1 | 3/2013 |
| WO | WO 2013/040049 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/022739 A2 | 2/2014 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A2 | 10/2014 |
| WO | WO 2015/010026 A2 | 1/2015 |
| WO | WO 2015/200539 A1 | 12/2015 |

OTHER PUBLICATIONS

Declaration of Jerzy Zabkiewicz executed Nov. 28, 2017, as filed by Opponent in Australian Patent Application No. 2014262189, pp. 1-73, submitted in IDS on Aug. 7, 2019 . . . (Year: 2017).*
Shintani, D., et al. "Antisense expression and overexpression of biotin carboxylase in tobacco leaves." Plant physiology 114.3 (1997): 881-886 (Year: 1997).*
Wang, C. J., and Z. Q. Liu. "Foliar uptake of pesticides—present status and future challenge." Pesticide Biochemistry and Physiology 87.1 (2007): 1-8. (Year: 2007).*
Tank Mixing Chemicals Applied to Peanut Crops, published online on Jul. 31, 2004 at www.peanut.ncsu.edu/pdffiles/004993/tank_mixing_chemicals_applied_to_peanut_crops.pdf (Year: 2004).*
Hörmann et al., "Tic32, an Essential Component in Chloroplast Biogenesis," *The Journal of Biological Chemistry*, 279:34756-34762 (2004).
Jarvis et al., "An *Arabidopsis* Mutant Defective in the Plastid General Protein Import Apparatus," *Science*, 282:100-102 (1998).
Kovacheva et al.,"In vivo Studies on the Roles of Tic110, Tic40 and Hsp93 During Chloroplast Protein Import" *The Plant Journal*, 41:412-428 (2005).
Zhong et al., A Pea Antisense Gene for the Chloroplast Stromal Processing Peptidase Yields Seedling Lethals in *Arabidopsis*: Survivors Show Defective Herewith GFP Import in vivo, *The Plant Journal*.34:802-812 (2003).
Ascencio-Ibanez et al., "DNA abrasion onto plants is an effective method for geminivirus infection and virus-induced gene silencing," Journal of Virological Methods, 142:198-203 (2007).
Bachman et al., "Characterization of the spectrum of insecticidal activity of a double-stranded RNA with targeted activity against Western Corn Rootworm (Diabrotica virgifera virgifera LeConte)," Transgenic Res., pp. 1-16 (2013).
Bedell et al., "Sorghum Genome Sequencing by Methylation Filtration," PLOS Biology, 3(1):E13/104-115 (2005).
Chen et al., "Exploring MicroRNA-Like Small RNAs in the Filamentous Fungus Fusarium oxysporum," PLOS One, 9(8):e104956:1-10 (2014).
Constan et al., "An outer envelope membrane component of the plastid protein import apparatus plays an essential role in *Arabidopsis*," The Plant Journal, 38:93-106 (2004).
Di Stilio et al., "Virus-Induced Gene Silencing as a Tool for Comparative Functional Studies in Thalictrum," PLoS One, 5(8):e12064 (2010).
Eamens et al., "RNA Silencing in Plants: Yesterday, Today, and Tomorrow," Plant Physiology, 147(2):456-468 (2008).
Fassler, BLAST Glossary, National Center for Biotechnology Information (2011).
Fernandez et al., "Uptake of Hydrophilic Solutes Through Plant Leaves: Current State of Knowledge and Perspectives of Foliar Fertilization," Critical Reviews in Plant Sciences, 28:36-38:(2009).

Friedberg, "Automated protein function prediction—the genomic challenge," Briefings in Bioinformatics, 7(3):225-242 (2006).
Funke et al., "Molecular basis for herbicide resistance in Roundup Ready crops," PNAS, 103:13010-13015 (2006).
Gaskin of al., "Novel organosillicone adjuvants to reduce agrochemical spray volumes on row crops," New Zealand Plant Protection, 53:350-354 (2000).
GenBank Accession No. EF143582 (2007).
Hagio, "Chapter 25: Direct Gene Transfer into Plant Mature Seeds via Electroporation After Vacuum Treatment," Electroporation and Sonoporation in Developmental Biology, p. 285-293 (2009).
Hess, "Surfactants and Additives," 1999 Proceedings of the California Weed Science Society, 51:156-172 (1999).
Huang et al., "In Vivo Analyses of the Roles of Essential Omp85-Related Proteins in the Chloroplast Outer Envelope Membrane," Plant Physiol., 157:147-159 (2011).
Ivanova et al., "Members of the Toc159 Import Receptor Family Represent Distinct.Pathways for Protein Targeting to Plastids," Molecular Biology of the Cell, 15:3379-3392 (2004).
Jacque et al., "Modulation of HIV-1 replication by RNA interference," Nature, 418, 435-438 (2002).
Jang et al., "Resistance to herbicides caused by single amino acid mutations in acetyl-CoA carboxylase in resistant populations of grassy weeds," New Phytologist, 197(4):1110-1116 (2013).
Kikkert et al., "Stable Transformation of Plant Cells by Particle Bombardment/Biolistics," Methods in Molecular Biology, 286:61-78 (2005).
Li et al., "A Simplified Seed Transformation Method for Obtaining Transgenic *Brassica napus* Plants," Agricultural Sciences in China, 8(6):658-663 (2009).
Liu et al, "The Helicase and RNaseIIIa Domains of *Arabidopsis* Dicer-Likel Modulate Catalytic Parameters during MicroRNA Biogenesis," Plant Physiology, 159:748-758 (2012).
McGinnis, "RNAi for functional genomics in plants," Brief Punct Genomics, 9(2):111-7 (2010).
Office Action dated Aug. 1, 2017, in European Patent Application No. 12 830 932.5.
Office Action dated Aug. 14, 2017, in Israeli Patent Application No. 235878.
Office Action dated Aug. 22, 2017, in Korean Patent Application No. 10-2012-7023415.
Office Action dated Aug. 3, 2017, in Chinese Patent Application No. 201480014392.5 (with English translation).
Office Acton dated Aug. 3, 2017, in European Patent Application No. 12 831 684.1.
Office Action dated Aug. 8, 2017, in Chilean Patent Application No. 201501874.
Office Action dated Dec. 13, 2016, in Ukrainian Patent Application No. a 2014 03843.
Office Action dated Dec. 14, 2016, in Ukrainian Patent Application No. a 2014 03850.
Office Action dated Dec. 15, 2016, in Ukrainian Patent Application No. a 2014 03845.
Office Action dated Dec. 15, 2016, in Ukrainian Patent Application No. a 2014 03849.
Office Action dated Dec. 15, 2016, in Ukrainian Patent Application No. a 2014 03852.
Office Action dated Dec. 27, 2016, in Ukrainian Patent Application No. a 2012 11548.
Office Action dated Jul. 11, 2017, in Mexican Patent Application No. MX/a/2015/013118 (with English translation).
Office Action dated Jul. 3, 2017, in Mexican Patent Application No. MX/a/2015/012632 (with English translation).
Office Action dated Jul. 6, 2017, in Mexican Patent Application No. MX/a/2015/013103 (with English translation).
Office Action dated Mar. 16, 2017, in Chinese Patent Application No. 201280054819.5.
Office Action dated May 3, 2016, in Chilean Patent Application No. 201601057.
Office Action dated Nov. 15, 2016, in Mexican Patent Application No. MX/a/2014/003068 (with English translation).
Office Action dated Sep. 6, 2017, in Chinese Patent Application No. 2014800154012 (with English translation).

(56) References Cited

OTHER PUBLICATIONS

Patent Examination Report No. 1 dated Jun. 8, 2017, in Australian Patent Application No. 2012308686.
Powles et al., "Evolution in Action: Plants Resistant to Herbicides," Annual Review of Plant Biology, 61(1):317-347 (2010).
Rakoczy-Trojanowska, "Alternative Methods of Plant Transformation—a short review," Cellular & Molecular Biology Letters, 7:849-858 (2002).
Richardson et al., "Targeting and assembly of components of the TOC protein import complex at the chloroplast outer envelope membrane," Frontiers in Plant Science, 5:1-14 (2014).
Search Report dated Jul. 24, 2017, in Chinese Patent Application No. 201480014392.5 (with English translation).
Small, "RNAi for revealing and engineering plant gene functions," Current Opinion in Biotechnology, 18:148-153 (2007).
Statement of Grounds and Particulars dated Sep. 1, 2017, in Australian Patent No. 201420189.
Trucco et al., "Amaranthus hybridus can be pollinated frequently by A. tubercidatus under filed conditions," Heredity, 94;64-70 (2005).
Voinnet, "Origin, Biogenesis, and Activity of Plant MicroRNAss" Cell, 136:669-687 (2009).
Wool et al., "Structure and evolution of mammalian ribosomal proteins," Biochem. Cell Biol., 73:933-947 (1995).
Written Opinion dated Mar. 6, 2017, in Singaporean Patent Application No. 2012061529.
Zhang, "Artificial trans-acting small interfering RNA: a tool for plant biology study and crop improvements," Planta, 239:1139-1146 (2014).
Zhong et al., "A forward genetic screen to explore chloroplast protein import in vivo identifies Moco sulfurase, pivotal for ABA and IAA biosynthesis and purine turnover," The Plant Journal, 63:44-59 (2010).
Agricultural Chemical Usage 2006 Vegetables Summary, Agricultural Statistics Board, NASS, USDA, pp. 1-372 (2007).
Agrios, *Plant Pathology* (Second Edition), 2:466-470 (1978).
Alarcón-Reverte et al., "Resistance to ACCase-inhibiting herbicides in the weed *Lolium multiflorum*," Comm. Appl. Biol. Sci., 73(4):899-902 (2008).
Al-Kaff et al., "Plants rendered herbicide-susceptible by cauliflower mosaic virus—elicited suppression of a 35S promoter-regulated transgene," Nature Biotechnology, 18:995-999 (2000).
Amarzguioui et al., "An algorithm for selection of functional siRNA sequences," Biochemical and Biophysical Research Communications, 316:1050-1058 (2004).
Ambrus et al., "The Diverse Roles of RNA Helicases in RNAi," Cell Cycle, 8(21):3500-3505 (2009).
An et al., "Transient RNAi Induction against Endogenous Genes in *Arabidopsis* Protoplasts Using in Vitro-Prepared Double-Stranded RNA," Biosci Biotechnol Biochem, 69(2):415-418 (2005).
Andersson et al., "A novel selection system for potato transformation using a mutated AHAS gene," Plant Cell Reports, 22(4):261-267 (2003).
Anonymous, "A handbook for high-level expression and purification of 6xHis-tagged proteins," The QiaExpressionist, (2003).
Anonymous, "Agronomy Facts 37: Adjuvants for enhancing herbicide performance," n. p., 1-8, (Jan. 26, 2000), Web, (Jan. 21, 2014).
Anonymous, "Devgen, The mini-Monsanto," KBC Securities (2006).
Anonymous, "Do Monsanto have the next big thing?," *Australian Herbicide Resistance Initiative (AHRI)*, (Apr. 23, 2013) Web. (Jan. 19, 2015).
Aoki et al., "In Vivo Transfer Efficiency of Antisense Oligonucleotides into the Myocardium Using HVJ—Liposome Method," Biochem Biophys Res Commun, 231:540-545 (1997).
Arpaia et al., "Production of transgenic eggplant (*Solanum melongena* L.) resistant to Colorado Potato Beetle (*Leptinotarsa decemlineata* Say)," (1997) Theor. Appl. Genet., 95:329-334 (1997).
Artymovich, "Using RNA interference to increase crop yield and decrease pest damage," MMG 445 Basic Biotech., 5(1):7-12 (2009).
Australian Patent Examination Report No. 1 dated Nov. 11, 2013, in Australian Application No. 2011224570.

Axtell et al., "A Two-Hit Trigger for siRNA Biogenesis in Plants," Cell, 127:565-577 (2006).
Baerson et al., "Glyphosate-Resistant Goosegrass. Identification of a Mutation in the Target Enzyme 5-Enolpyruvylshikimate-3-Phosphate Synthase," Plant in Physiol., 129(3):1265-1275 (2002).
Bai et al., "Naturally Occurring Broad-Spectrum Powdery Mildew Resistance in a Central American Tomato Accession Is Caused by Loss of Mlo Function," MPMI, 21(1):30-39 (2008).
Balibrea et al., "Extracellular Invertase is an Essential Component of Cytokinin-Mediated Delay of Senescence," The Plant Cell, 16(5):1276-1287 (2004).
Bannerjee et al., "Efficient production of transgenic potato (*S. tuberosum* L. ssp. *andigena*) plants via *Agrobacterium tumefaciens*-mediated transformation," Plant Sci., 170:732 738 (2006).
Bart et al., "A novel system for gene silencing using siRNAs in rice leaf and stem-derived protoplasts," Plant Methods, 2(13):1-9 (2006).
Basu et al., "Weed genomics: new tools to understand weed biology," TRENDS in Plant Science, 9(8):391-398 (2004).
Baulcombe, "RNA silencing and heritable epigenetic effects in tomato and *Arabidopsis*," Abstract 13$^{th}$ Annual Fall Symposium, Plant Genomes to Phenomes, Donald Danforth Plant Science Center, 28-30 (2011).
Bayer et al., "Programmable ligand-controlled riboregulators of eukaryotic gene expression," Nature Biotechnol., 23(3):337-343 (2005).
Beal, et al., "Second Structural Motif for Recognition of DNA by Oligonucleotide-Directed Triple-Helix Formation," Science, 251:1360-1363 (1992).
Becker et al., "Fertile transgenic wheat from microprojectile bombardment of scutellar tissue," The Plant Journal, 5(2):299-307 (1994).
Bhargava et al., "Long double-stranded RNA-mediated RNA interference as a tool to achieve site-specific silencing of hypothalamic neuropeptides," Brain Research Protocols, 13:115-125 (2004).
Boletta et al., "High Efficient Non-Viral Gene Delivery to the Rat Kidney by Novel Polycationic Vectors," J. Am Soc. Nephrol., 7:1728 (1996).
Bolognesi et al., "Characterizing the Mechanism of Action of Double-Stranded RNA Activity against Western Corn Rootworm(*Diabrotica virgifera virgifera* LeConte)," PLoS One 7(10):e47534 (2012).
Bolter et al., "A chloroplastic inner envelope membrane protease is essential for plant development," FEBS Letters, 580:789-794 (2006).
Bourgeois et al., "Field and producer survey of ACCase resistant wild oat in Manitoba," Canadian Journal of Plant Science, 709-715 (1997).
Breaker et al., "A DNA enzyme with Mg2$^+$-dependent RNA phosphoesterase activity," Chemistry and Biology, 2:655-660 (1995).
Brodersen et al., "The diversity of RNA silencing pathways in plants," Trends in Genetics, 22(5):268-280 (2006).
Brugière et al., "Glutamine Synthetase in the Phloem Plays a Major Role in Controlling Proline Production," The Plant Cell, 11:1995-2011 (1999).
Busch et al., "RNAi for discovery of novel crop protection products," Pflanzenschutz-Nachrichten Bayer, 58(1):34-50 (2005).
Busi et al., "Gene flow increases the initial frequency of herbicide resistance alleles in unselectedpopulations," Agriculture, Ecosystems and Environments, Elsevier, Amsterdam, NL, 142(3):403-409 (2011).
Butler et al., "Priming and re-drying improve the survival of mature seeds of *Digitalis purpurea* during storage," Annals of Botany, 103:1261-1270 (2009).
Bytebier et al., "T-DNA organization in tumor cultures and transgenic plants of the monocotyledon *Asparagus officinalis*," Proc. Natl. Acad. Sci. U.S.A., 84:5345-5349 (1987).
Campbell et al., "Gene-knockdown in the honey bee mite *Varroa destructor* by a non-invasive approach: studies on a glutathione S-transferase," Parasites & Vectors, 3(1):73, pp. 1-10 (2010).
Chabannes et al., "In situ analysis of lignins in transgenic tobacco reveals a differential impact of individual transformations on the spatial patterns of lignin deposition at the cellular and subcellular levels," The Plant Journal, 28(3):271-282 (2001).

(56) References Cited

OTHER PUBLICATIONS

Chabbouh et al., "Cucumber mosaic virus in artichoke," *FAO Plant Protection Bulletin*, 38:52-53 (1990).
Chakravarty et al., "Genetic Transformation in Potato: Approaches and Strategies," *Amer J Potato Res*, 84:301 311 (2007).
Chang et al., "Cellular Internalization of Fluorescent Proteins via Arginine-rich Intracellular Delivery Peptide in Plant Cells," *Plant Cell Physiol.*, 46(3):482-488 (2005).
Chee et al., "Transformation of Soybean (*Glycine max*) by Infecting Germinating Seeds with *Agrobacterium tumefaciens*," *Plant Physiol.*, 91:1212-1218 (1989).
Chen et al., "In Vivo Analysis of the Role of atTic20 in Protein Import into Chloroplasts," *The Plant Cell*, 14:641-654 (2002).
Chen et al., "Transfection and Expression of Plasmid DNA in Plant Cells by an Arginine-Rich Intracellular Delivery Peptide without Protoplast Preparation," *FEBS Letters* 581, pp. 1891-1897 (2007).
Cheng et al., "Production of fertile transgenic peanut (*Arachis hypogaea* L.) plants using *Agrobacterium tumefaciens*," *Plant Cell Reports*, 15:653-657 (1996).
Chi et al., "The Function of RH22, a DEAD RNA Helicase, in the Biogenesis of the 50S Ribosomal Subunits of *Arabidopsis* Chloroplasts," *Plant Physiology*, 158:693-707 (2012).
Chupp et al., "Chapter 8: White Rust," *Vegetable Diseases and Their Control*, The Ronald Press Company, New York, pp. 267-269 (1960).
Clough et al., "Floral dip: a simplified method for Agrobacterium-mediated transformation of *Arabidopsis thaliana*," *The Plant Journal*, 16(6):735-743 (1998).
CN101914540 Patent Diclosure, "Introduction of RNA into plant by interference," (2010).
Colbourne et al., "The Ecoresponive Genome of Daphnia pulex," *Science*, 331(6017):555-561 (2011).
Colliver et al., "Differential modification of falvonoid and isoflavonoid biosynthesis with an antisense chalcone synthase construct in transgenic *Lotus corniculatus*," *Plant Molecular Biology*, 35:509-522 (1997).
Columbian Office Action dated Aug. 2, 2013 in U.S. Appl. No. 12/152,898.
Columbian Office Action dated Feb. 21, 2014 in U.S. Appl. No. 12/152,898.
Communication pursuant to Article 94(3) EPC dated Jan. 14, 2016, in European Patent Application No. 12 832 415.9.
Communication pursuant to Article 94(3) EPC dated Jun. 26, 2015, in European Patent Application No. 11 753 916.3.
Communication pursuant to Article 94(3) EPC dated Mar. 18, 2016, in European Patent Application No. 12 832 160.1
Communication pursuant to Article 94(3) EPC dated Mar. 24, 2016, in European Patent Application No. 12 831 684.1.
Communication pursuant to Article 94(3) EPC dated Mar. 4, 2016, in European Patent Application No. 12 830 932.5.
Communication pursuant to Article 94(3) EPC dated Mar. 9, 2016, in European Patent Application No. 12 831 166.9.
Communication pursuant to Article 94(3) EPC dated Oct. 23, 2015, in European Patent Application No. 12 831 945.6.
Concise Descriptions of Relevance filed by a third party on Nov. 29, 2012, in U.S. Appl. No. 13/042,856.
Cooney et al., "Site-Specific Oligonucleotide Binding Represses Transcription of the Human c-myc Gene in Vitro," *Science*,241:456-459 (1988).
Cost Action FA0806 progress report "Plant virus control employing RNA-based vaccines: A novel non-transgenic strategy" (2010).
Coticchia et al., "Calmodulin modulates Akt activity in human breast cancer cell lines," *Breast Cancer Res. Treat*, 115:545-560 (2009).
Dalakouras et al., "Induction of Silencing in Plants by High-Pressure Spraying of In vitro-Synthesized Small RNAs," *Frontiers in Plant Science*, 7(1327):1-5 (2016).
Dalmay et al., "An RNA-Depenedent RNA Polymerase Gene in *Arabidopsis* is Required for Posttranscriptional Gene Silencing Mediated by a Transgene but Not by a Virus," *Cell*, 101:543-553 (2000).
Database EMBL CBIB Daphnia—XP-002732239 (2011).
Davidson et al., "Engineering regulatory RNAs," *TRENDS in Biotechnology*, 23(3):109-112 (2005).
Dawson et al., "cDNA cloning of the complete genome of tobacco mosaic virus and production of infectious transcripts," *Proc. Natl. Acad. Sci. USA*, 83:1832-1836 (1986).
De Block, et al. "Engineering herbicide resistance in plants by expression of a detoxifying enzyme," *EMBO J.* 6(9):2513-2519 (1987).
De Framond, "MINI-Ti: A New Vector Strategy for Plant Genetic Engineering," *Nature Biotechnology*, 1:262-269 (1983).
Della-Cioppa et al., "Import of a precursor protein into chloroplasts is inhibited by the herbicide glyphosate," *The EMBO Journal*, 7(5):1299-1305 (1988).
Desai et al., "Reduction in deformed wing virus infection in larval and adult honey bees (*Apis mellifera* L.) by double-stranded RNA ingestion," *Insect Molecular Biology*, 21(4):446-455 (2012).
Diallo et al., "Long Endogenous dsRNAs Can Induce Complete Gene Silencing in Mammalian Cells and Primary Cultures," *Oligonucleotides*, 13:381-392 (2003).
Dietemann et al., "*Varroa destructor*: research avenues towards sustainable control," *Journal of Apicultural Research*, 51(1):125-132 (2012).
Du et al., "A systematic analysis of the silencing effects of an active siRNA at all single-nucleotide mismatched target sites," *Nucleic Acids Research*, 33(5):1671-1677 (2005).
Dunoyer et al., "Small RNA Duplexes Function as Mobile Silencing Signals Between Plant Cells," *Science*, 328:912-916 (2010).
Ellington et al., "In vitro selection of RNA molecules that bind specific ligands," *Nature*, 346:818-822 (1990).
Emery et al., "Radial Patterning of *Arabidopsis* Shoots by Class III HD-ZIP and Kanadi Genes," *Current Biology*, 13:1768-1774 (2003).
European Cooperation in the field of Scientific and Technical Research—Memorandum of Understanding for COST Action FA0806 (2008).
Extended European Search Report dated Feb. 2, 2015, in European Patent Application No. 12 830 932.5.
Extended European Search Report dated Feb. 27, 2015, in European Patent Application No. 12 832 160.1.
Extended European Search Report dated Feb. 3, 2015, in European Patent Application No. 12 831 945.6.
Extended European Search Report dated Jan. 20, 2016, in European Patent Application No. 13 794 339.5.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Jun. 29, 2015, in European Patent Application No. 12 831 494.5.
Extended European Search Report dated Mar. 17, 2015, in European Patent Application No. 12 831 684.1.
Extended European Search Report dated Mar. 3, 2015, in European Patent Application No. 12 831 166.9.
Extended European Search Report dated Oct. 8, 2013, in European Patent Application No. 11753916.3.
Extended European Search Report dated Sep. 29, 2016, in European Patent Application No. 14778840.0.
Farooq et al., "Rice seed priming," *IPRN*, 30(2):45-48 (2005).
Feuillet et al., "Crop genome sequencing: lessons and rationales," *Trends Plant Sci.*, 16:77-88 (2011).
Final Office Action dated Apr. 7, 2016, in U.S. Appl. No. 13/619,980.
Final Office Action dated Dec. 17, 2015, in U.S. Appl. No. 14/335,135.
Final Office Action dated Feb. 17, 2016, in U.S. Appl. No. 13/612,929.
Final Office Action dated Feb. 4, 2016, in U.S. Appl. No. 13/612,936.
Final Office Action dated Jun. 30, 2016, in U.S. Appl. No. 13/901,326.
Final Office Action dated Mar. 2, 2016, in U.S. Appl. No. 13/612,995.
Final Office Action dated Mar. 21, 2016, in U.S. Appl. No. 13/612,925.
Final Office Action dated May 26, 2016, in U.S. Appl. No. 14/532,596.
Final Office Action dated Sep. 9, 2016, in U.S. Appl. No. 13/612,954.

(56) References Cited

OTHER PUBLICATIONS

Final Office Action dated Nov. 10, 2015, in U.S. Appl. No. 13/612,985.
Final Office Action dated Nov. 19, 2015, in U.S. Appl. No. 13/612,941.
Final Office Action dated Nov. 10, 2016, in U.S. Appl. No. 13/583,302.
Final Office Action dated Nov. 30, 2015, in U.S. Appl. No. 13/612,948.
Final Office Action dated Sep. 9, 2016, in U.S. Appl. No. 14/608,951.
Final Office Action dated Sep. 9, 2016, in U.S. Appl. No. 14/603,347.
Final Office Action dated Nov. 7, 2013, in U.S. Appl. No. 13/042,856.
Final Office Action dated Oct. 20, 2016, in U.S. Appl. No. 14/480,199.
Final Office Action dated Oct. 22, 2015, in U.S. Appl. No. 14/608,951.
Fire et al., "Potent and specific genetic interference by double-stranded RNA in *Caenorhabditis elegans*," *Nature*, 391:806-811 (1998).
First Examination Report dated Apr. 23, 2013, in New Zealand Patent Application No. 601784.
First Examination Report dated Jul. 28, 2014, in New Zealand Patent Application No. 627060.
First Office Action dated Aug. 31, 2015, in Chinese Patent Application No. 201280053985.3.
First Office Action dated Feb. 2, 2016, in Chinese Patent Application No. 201380039346.6.
First Office Action dated Jul. 7, 2015, in Chinese Patent Application No. 201280054820.8.
First Office Action dated Mar. 12, 2015, in Chinese Patent Application No. 201280053984.9.
First Office Action dated Mar. 2, 2015, in Chinese Patent Application No. 201280054819.5.
First Office Action dated May 27, 2015, in Chinese Patent Application No. 201280054179.8.
First Office Action dated Sep. 9, 2015, in Chinese Patent Application No. 201280055409.2.
Fraley et al., "Liposome-mediated delivery of tobacco mosaic virus RNA into tobacco protoplasts: A sensitive assay for monitoring liposome-protoplast interactions," *Proc Natl Acad Sci U S A.*, 79(6):1859-1863 (1982).
Fukuhara et al., "Enigmatic Double-Stranded RNA in Japonica Rice," *Plant Molecular Biology*, 21:1121-1130 (1993).
Fukuhara et al., "The Unusual Structure of a Novel RNA Replicon in Rice," *The Journal of Biological Chemistry*, 270(30):18147-18149 (1995).
Fukuhara et al., "The wide distribution of endornaviruses, large double-stranded RNA replicons with plasmid-like properties," *Archives of Virology*, 151:995-1002 (2006).
Fukunaga et al., "dsRNA with 5' overhangs v contributes to endogenous and antiviral RNA silencing pathways in plants," *The EMBO Journal*, 28(5):545-555 (2009).
Further Examination Report dated May 16, 2014, in New Zealand Patent Application No. 601784.
Gaines et al., "Gene amplification confers glyphosate resistance in *Amaranthus palmeri*," *Proc. Natl. Acad. Sci. USA*, 107(3):1029-1034 (2010).
Gan et al., "Bacterially expressed dsRNA protects maize against SCMV infection," *Plant Cell Rep*, 11:1261-1268 (2010).
Gan et al., "Inhibition of Leaf Senescence by Autoregulated Production of Cytokinin," *Science*, 270:1986-1988 (1995).
Gao et al., "Down-regulation of acetolactate synthase compromises 01-1-mediated resistance to powdery mildew in tomato," *BMC Plant Biology*, 14 (2014).
Gao et al., "Nonviral Methods for siRNA Delivery," *Molecular Pharmaceutics*, 6(3):651-658 (2008).
Garbian et al., "Bidirectional Transfer of RNAi between Honey Bee and *Varroa destructor*: *Varroa* Gene Silencing Reduces *Varroa* Population," 8(12):1-9:e1003035 (2012).
Ge et al., "Rapid vacuolar sequestration: the horseweed glyphosate resistance mechanism," *Pest Management Sci.*, 66:345-348 (2010).
GenBank Accession No. AY545657.1 (2004).
GenBank Accession No. CB377464, "CmaE1_37_J02_T3 Cowpea weevil larvae Lambda Zap Express Library Callosobruchus maculatus cDNA, mRNA sequence," (2007).
GenBank Accession No. DY640489, "PU2_plate27_F03 PU2 Prunus persica cDNA similar to expressed mRNA inferred from Prunus persica hypothetical domain/motif cont aining IPR011005:Dihydropteroate synthase-like, MRNA sequence" (2006).
GenBank Accession No. EU024568, "Amaranthus hypochondriacus acetolactate synthase (ALS) gene" (2007).
GenBank Accession No. EW765249, "ST020010B10C12 Normalized and subtracted western corn rootworm female head cDNA library Diabrotica virgifera virgifera cDNA clone ST020010B10C12 5-, mRNA sequence," (2007).
GenBank Accession No. EW771198, "ST020010B10C12 Normalized and subtracted western corn rootworm female head cDNA library Diabrotica virgifera virgifera cDNA clone ST020010B10C12 5-, mRNA sequence," (2007).
GenBank Accession No. FE348695, "CBIB7954.fwd CBIB_Daphnia_pulex_Chosen_One_Library_2 Daphnia pulex cDNA clone CBIB7954 5', mRNA sequence" (2011).
GenBank Accession No. FJ972198, "Solanum lycopersicum cultivar Ailsa Craig dihydropterin pyrophosphokinase-dihydropteroate synthase (HPPK-DHPS) gene, complete cds" (2010).
GenBank Accession No. GI:186478573 (2014).
GenBank Accession No. GU120406, "Chrysomela tremulae ribosomal protein L7 (RpL7) mRNA, complete cds" (2009).
GenBank Accession No. HD315444, "Sequence 192160 from Patent EP2213738" (2010).
GenBank Accession No. Q4GXM3_BIPLU, "Ribosomal protein L7e" (2006).
GenBank Accession No. U87257.1, "Daucus carota 4-hydroxyphenylpyruvate dioxygenase mRNA, complete cds" (1997).
GenBank Accession No. XM_014456745.1, Predicted: Myotis lucifugus ribonucleoprotein, PTB-binding 2 (RAVER2), transcript variant X3, mRNA,: (2015).
GenBank Accession No. Y08611.1, "P.sativum mRNA for dihydropterin pyrophosphokinase/dihydropteroate synthase." (2006).
GenEmbl Accession No. FJ861243 (2010).
Gong et al., "Silencing of Rieske iron-sulfur protein using chemically synthesised siRNA as a potential biopesticide against Plutella xylostella," *Pest Manag Sci*, 67:514-520 (2011).
Gossamer Threads, Compendium of Herbicide Adjuvants: Organo-Silicone Surfactant, p. 1-4 (1998).
Gressel et al., "A strategy to provide long-term control of weedy rice while mitigating herbicide resistance transgene flow, and its potential use for other crops with related weeds," *Pest Manag Sci*, 65(7):723-731 (2009).
Gudkov, "Minireview: The L7/L12 ribosomal domain of the ribosome: structural and functional studies," *FEBS Letters*, 407:253-256 (1997).
Gutensohn et al., "Functional analysis of the two *Arabidopsis* homologues of Toc34, a component of the chloroplast protein import apparatus," *The Plant Journal*, 23(6):771-783 (2000).
Haigh, "The Priming of Seeds: Investigation into a method of priming large quantities of seeds using salt solutions," Thesis submitted to Macquarie University (1983).
Hajirezaei et al., "Impact of elevated cytosolic and apoplastic invertase activity on carbon metabolism during potato tuber development," *Journal of Experimental Botany*, 51:439-445 (2000).
Hamilton et al., "Guidelines for the Identification and Characterization of Plant Viruses," *J. gen. Virol.*, 54:223-241 (1981).
Hamilton et al., "Two classes of short interfering RNA in RNA silencing," *EMBO J.*, 21(17):4671-4679 (2002).
Han et al., "Molecular Basis for the Recognition of Primary microRNAs by the Drosha-DGCR8 Complex," *Cell*, 125(5):887-901 (2006).
Hannon, "RNA interference," *Nature*,481:244-251 (2002).
Hardegree, "Drying and storage effects on germination of primed grass seeds," *Journal of Range Management*, 47(3):196-199 (1994).
Harrison et al., "Does Lowering Glutamine Synthetase Activity in Nodules Modigy Nitrogen Metabolism and Growth of *Lotus japonicus?*," *Plant Physiology*, 133:253-262 (2003).
Heffer et al., "Rapid isolation of gene homologs across taxa: Efficient identification and isolation of gene orthologs from non-model organism genomes, a technical report," *EvoDevo Journal*, 2(7):1-5 (2011).

(56) References Cited

OTHER PUBLICATIONS

Herman et al., "A three-component dicamba O-demethylase from *Pseudomonas maltophilia*, strain DI-6: gene isolation, characterization, and heterologous expression," *J. Biol. Chem.*, 280: 24759-24767 (2005).
Hewezi et al., "Local infiltration of high- and low-molecular-weight RNA from silenced sunflower (*Helianthus annuus* L.) plants triggers post-transcriptional gene silencing in non-silenced plants," *Plant Biotechnology Journal*, 3:81-89 (2005).
Hidayat et al., "Enhanced Metabolism of Fluazifop Acid in a Biotype of *Digitaria sanguinalis* Resistant to the Herbicide Fluazifop-P-Butyl," *Pesticide Biochem. Physiol.*, 57:137-146 (1997).
Himber et al., "Transitivity-dependant and -independent cell-to-cell movement of RNA silencing," *The EMBO Journal*, 22(17):4523-4533 (2003).
Hirschberg et al., "Molecular Basis of Herbicide Resistance in *Amaranthus hybridus*," *Science*, 222:1346-1349 (1983).
Hoekema et al., "A binary plant vector strategy based on separation of vir- and T-region of the *Agrobacterium tumefaciens* Ti-plasmid," *Nature*, 303:179-180 (1983).
Hofgen et al., "Repression of Acetolactate Synthase Activity through Antisense Inhibition: Molecular and Biochemical Analysis of Transgenic Potato (*Solanum tuberosum* L. cv Desiree) Plants," *Plant Physiol.*, 107(2):469-477 (1995).
Holtra et al., "Assessment of the Physiological Condition of *Salvinia natans* L. Exposed to Copper(II) Ions," *Environ. Protect. Eng.*, 41:147-158 (2015).
Hsieh et al., "A library of siRNA duplexes targeting the phosphoinositide 3-kinase pathway: determinants of gene silencing for use in cell-based screens," *Nucleic Acids Res.*, 32(3):893-901 (2004).
Huesken et al., "Design of a genome-wide siRNA library using an artificial neural network," *Nature Biotechnology*, 23(8): 995-1001 (2005).
Hunter et al., "RNA Interference Strategy to suppress Psyllids & Leafhoppers," *International Plant and Animal Genome XIX*, 15-19 (2011).
Ichihara et al., "Thermodynamic instability of siRNA duplex is a prerequisite for dependable prediction of siRNA activities," *Nucleic Acids Res.*, 35(18):e123 (2007).
International Preliminary Report on Patentability (Chapter II) dated Jul. 24, 2015, in International Application No. PCT/US2014/047204.
International Preliminary Report on Patentability dated Sep. 11, 2012, in International Application No. PCT/US2011/027528.
International Preliminary Report on Patentability dated Sep. 11, 2014, in International Application No. PCT/IL2013/050447.
International Rice Genome Sequencing Project, The map-based sequence of the rice genome, *Nature*, 436(11):793-800 (2005).
International Search Report and the Written Opinion dated Feb. 25, 2013, in International Application No. PCT/US2012/054883.
International Search Report and the Written Opinion dated Feb. 27, 2013, in International Application No. PCT/US2012/054814.
International Search Report and the Written Opinion dated Feb. 27, 2013, in International Application No. PCT/US2012/054842.
International Search Report and the Written Opinion dated Feb. 27, 2013, in International Application No. PCT/US2012/054862.
International Search Report and the Written Opinion dated Feb. 27, 2013, in International Application No. PCT/US2012/054894.
International Search Report and the Written Opinion dated Feb. 27, 2013, in International Application No. PCT/US2012/054974.
International Search Report and the Written Opinion dated Feb. 27, 2013, in International Application No. PCT/US2012/054980.
International Search Report and the Written Opinion dated Jul. 15 2014, in International Application No. PCT/US2014/025305.
International Search Report and the Written Opinion dated Jul. 22 2014, in International Application No. PCT/IL2013/051083.
International Search Report and the Written Opinion dated Jul. 22, 2014, in International Application No. PCT/IL2013/051085.
International Search Report and the Written Opinion dated Jul. 24, 2014, in International Application No. PCT/US2014/026036.
International Search Report and the Written Opinion dated May 10, 2011, in International Application No. PCT/US2011/027528.
International Search Report and the Written Opinion dated Oct. 1, 2013, in International Application No. PCT/IL2013/050447.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report and Written Opinion dated Jul. 8, 2015, in International Application No. PCT/US2015/011408.
International Search Report and Written Opinion dated Mar. 26, 2015, in International Application No. PCT/US2014/069353.
International Search Report and Written Opinion dated May 26, 2016, in International Application No. PCT/US2016/014344.
International Search Report and Written Opinion dated Nov. 24, 2015, in International Application No. PCT/US2015/037522.
International Search Report and Written Opinion dated Nov. 27, 2015, in International Application No. PCT/US2015/037015.
International Search Report dated Mar. 12, 2013, in International Application No. PCT/US2012/054789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Invitation to Pay Additional Fees dated Sep. 8, 2015, in International Application No. PCT/US2015/037015.
Invitation to Pay Additional Fees dated Sep. 9, 2015, in International Application No. PCT/US2015/037522.
Isaacs et al., "Engineered riboregulators enable post-transcriptional control of gene expression," *Nature Biotechnology*, 22(7):841-847 (2004).
Ji et al., "Regulation of small RNA stability: methylation and beyond," *Cell Research*, 22:624-636 (2012).
Jin et al., "Posttranslational Elevation of Cell Wall Invertase Activity by Silencing its Inhibitor in Tomato Delays Leaf Senescence and Increases Seed Weight and Fruit Hexose Level," *The Plant Cell*, 21:2072-2089 (2009).
Jofre-Garfias et al., "Agrobacterium-mediated transformation of Amaranthus *hypochondriacus*: light- and tissue-specific expression of a pea chlorophyll a/b-binding protein promoter," *Plant Cell Reports*, 16:847-852 (1997).
Jones-Rhoades et al., "MicroRNAs and Their Regulatory Roles in Plants," *Annu. Rev. Plant Biol.*, 57:19-53 (2006).
Josse et al., "A Della in Disguise: SPATULA Restrains the Growth of the Developing *Arabidopsis* Seedling," *Plant Cell*, 23:1337-1351 (2011).
Kaloumenos et al., "Identification of a Johnsongrass (*Sorghum halepense*) Biotype Resistant to ACCase-Inhibiting Herbicides in Northern Greece," *Weed Technol*, 23:470-476 (2009).
Kam et al., "Nanotube Molecular Transporters: Internalization of Carbon Nanotube—Protein Conjugates into Mammalian Cells," *J. Am. Chem. Soc.*, 126(22):6850-6851 (2004).
Kambiranda et al., "Relationship Between Acid Invertase Activity and Sugar Content in Grape Species," *Journal of Food Biochemistry*, 35:1646-1652 (2011).
Katoh et al., "Specific residues at every third position of siRNA shape its efficient RNAi activity," *Nucleic Acids Res.*, 35(4): e27 (2007).
Kertbundit et al., "In vivo random β-glucuronidase gene fusions in *Arabidopsis thaliana*," *Proc. Natl. Acad. Sci. U S A.*, 88:5212-5216 (1991).
Khachigian, "DNAzymes: Cutting a path to a new class of therapeutics," *Curr Opin Mol Ther* 4(2):119-121 (2002).
Khan et al., "Matriconditioning of Vegetable Seeds to Improve Stand Establishment in Early Field Plantings," *J. Amer. Soc. Hort. Sci.*, 117(1):41-47 (1992).
Khodakovskaya et al., "Carbon Nanotubes Are Able to Penetrate Plant Seed Coat and Dramatically Affect Seed Germination and Plant Growth," *ACS Nano*, 3(10):3221-3227 (2009).

(56) References Cited

OTHER PUBLICATIONS

Kim et al., "Optimization of Conditions for Transient Agrobacterium-Mediated Gene Expression Assays in *Arabidopsis*," *Plant Cell Reports*, 28:1159-1167 (2009).
Kim et al., "Synthetic dsRNA Dicer substrates enhance RNAi potency and efficacy," *Nature Biotechnology*, 23(2):222-226 (2005).
Kirkwood, "Herbicides and Plants," *Botanical Journal of Scotland*, 46(3):447-462 (1993).
Kirkwood, "Use and Mode of Action of Adjuvants for Herbicides: A Review of some Current Work," *Pestic Sci.*, 38:93-102 (1993).
Klahre et al., "High molecular weight RNAs and small interfering RNAs induce systemic posttranscriptional gene silencing in plants," *Proc. Natl. Acad. Sci. USA*, PNAS, 99(18):11981-11986 (2002).
Knudsen, "Promoter2.0: for the recognition of Poll promoter sequences," *Bioniformatics*, 15(5):356-361 (1999).
Kronenwett et al., "Oligodeoxyribonucleotide Uptake in Primary Human Hematopoietic Cells Is Enhanced by Cationic Lipids and Depends on the Hematopoietic Cell Subset," *Blood*, 91(3):852-862 (1998).
Kusaba et al., "*Low glutelin content1*: A Dominant Mutation That Suppresses the *Glutelin* Multigene Family via RNA Silencing ni Rice," *The Plant Cell*, 15(6):1455-1467 (2003).
Kusaba, "RNA interference in crop plants," *Curr Opin Biotechnol*, 15(2):139-143 (2004).
Lavigne et al., "Enhanced antisense inhibition of human immunodeficiency virus type 1 in cell cultures by DLS delivery system," *Biochem Biophys Res Commun*, 237:566-571 (1997).
Lee et al., "Aptamer Database," *Nucleic Acids Research*, 32:D95-D100 (2004).
Lein et al., "Target-based discovery of novel herbicides," *Current Opinion in Plant Biology*, 7:219-225 (2004).
Leopold et al., "Chapter 4: Moisture as a Regulator of Physiological Reaction in Seeds," *Seed Moisture, CSSA Special Publication No. 14*, pp. 51-69 (1989).
Lermontova et al., "Reduced activity of plastid protoporphyrinogen oxidase causes attenuated photodynamic damage during high-light compared to low-light exposure," *The Plant Journal*, 48(4):499-510 (2006).
Lesnik et al., "Prediction of rho-independent transcriptional terminators in *Escherichia coli*," *Nucleic Acids Research*, 29(17):3583-3594 (2001).
Li et al., "Establishment of a highly efficient transformation system for pepper (*Capsicum annum* L.)," *Plant Cell Reports*, 21: 785-788 (2003).
Li et al., "The FAST technique: a simplified Agrobacterium-based transformation method for transient gene expression analysis in seedlings of *Arabidopsis* and other plant species," *Plant Methods*, 5(6):1-15 (2009).
Liu et al., "Carbon Nanotubes as Molecular Transporters for Walled Plant Cells," *Nano Letters*, 9(3):1007-1010 (2009).
Liu et al., "Comparative study on the interaction of DNA with three different kinds of surfactants and the formation of multilayer films," *Bioelectrochemistry*, 70:301-307 (2007).
Liu et al., "DNAzyme-mediated recovery of small recombinant RNAs from a 5S rRNA-derived chimera expressed in *Escherichia coli*," *BMC Biotechnology*, 10:85 (2010).
Liu et al., "Identification and Application of a Rice Senescence-Associated Promoter," *Plant Physiology*, 153:1239-1249 (2010).
Liu, "Influence of Sugars on the Foliar Uptake of Bentazone and Glyphosate," *New Zealand Plant Protection*, 55:159-162 (2002).
Llave et al., "Endogenous and Silencing-Associated Small RNAs in Plants," *The Plant Cell*, 14:1605-1619 (2002).
Lu et al., "OligoWalk: an online siRNA design tool utilizing hybridization thermodynamics," *Nucleic Acids Research*, 36:W104-W108 (2008).
Lu et al., "RNA silencing in plants by the expression of siRNA duplexes," *Nucleic Acids Res.*, 32(21):e171 (2004).
Luft, "Making sense out of antisense oligodeoxynucleotide delivery: getting there is half the fun," *J Mol Med*, 76:75-76 (1998).

Luque et al., "Water Permeability of Isolated Cuticular Membranes: A Structural Analysis," *Archives of Biochemistry and Biophysics*, 317(2):417-422 (1995).
Maas et al., "Mechanism and optimized conditions for PEG mediated DNA transfection into plant protoplasts," *Plant Cell Reports*, 8:148-149 (1989).
MacKenzie et al., "Transgenic *Nicotiana debneyii* expressing viral coat protein are resistant to potato virus S infection," *Journal of General Virology*, 71:2167-2170 (1990).
Maher III et al., "Inhibition of DNA binding proteins by oligonucleotide-directed triple helix formation," *Science*, 245(4919):725-730 (1989).
Makkouk et al., "Virus Diseases of Peas, Beans, and Faba Bean in the Mediterranean region," *Adv Virus Res*, 84:367-402 (2012).
Mandal et al., "Adenine riboswitches and gene activation by disruption of a transcription tenninator," *Nature Struct. Mol. Biol.*, 11(1):29-35 (2004).
Mandal et al., "Gene Regulation by Riboswitches," *Nature Reviews |Molecular Cell Biology*, 5:451-463 (2004).
Manoharan, "Oligonucleotide Conjugates as Potential Antisense Drugs with Improved Uptake, Biodistribution, Targeted Delivery, and Mechanism of Action," *Antisense & Nucleic Acid Drug Development*, 12:103-128 (2002).
Maori et al., "IAPV, a bee-affecting virus associated with Colony Collapse Disorder can be silenced by dsRNA ingestion," *Insect Molecular Biology*, 18(1):55-60 (2009).
Masoud et al., "Constitutive expression of an inducible β-1,3-glucanase in alfalfa reduces disease severity caused by the oomycete pathogen *Phytophthora megasperma* f. sp *medicaginis*, but does not reduce disease severity of chitincontaining fungi," *Transgenic Research*, 5:313-323 (1996).
Matveeva et al., "Prediction of antisense oligonucleotide efficacy by in vitro methods," *Nature Biotechnology*, 16:1374-1375 (1998).
Meinke, et al., "Identifying essential genes in *Arabidopsis thaliana*," *Trends Plant Sci.*, 13(9):483-491 (2008).
Meins et al., "RNA Silencing Systems and Their Relevance to Plant Development," *Annu. Rev. Cell Dev. Biol.*, 21:297-318 (2005).
Melnyk et al., "Intercellular and systemic movement of RNA silencing signals," *The EMBO Journal*, 30:3553-3563 (2011).
Migge et al., "Greenhouse-grown conditionally lethal tobacco plants obtained by expression of plastidic glutamine synthetase antisense RNA may contribute to biological safety," *Plant Science* 153:107-112 (2000).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Misawa et al., "Functional expression of the *Erwinia uredovora* carotenoid biosynthesis gene crtI in transgenic plants showing an increase of β-carotene biosynthesis activity and resistance to the bleaching herbicide norflurazon," *The Plant Journal*, 4(5):833-840 (1993).
Miura et al., "The Balance between Protein Synthesis and Degradation in Chloroplasts Determines Leaf Variegation in *Arabidopsis yellow variegated* Mutants," *The Plant Cell*, 19:1313-1328 (2007).
Molina et al., "Inhibition of protoporphyrinogen oxidase expression in *Arabidopsis* causes a lesion-mimic phenotype that induces systemic acquired resistance," *The Plant Journal*, 17(6):667-678 (1999).
Molnar et al., "Plant Virus-Derived Small Interfering RNAs Originate redominantly from Highly Structured Single-Stranded Viral RNAs," *Journal of Virology*, 79(12):7812-7818 (2005).
Molnar et al., "Small Silencing RNAs in Plants Are Mobile and Direct Epigenetic Modification in Recipient Cells," *Science*, 328:872-875 (2010).
Mora et al., "How Many Species Are There on Earth and in the Ocean?," *PLOS Biol.*, 9(8):e100127, p. 1-8 (2011).
Moriyama et al., "Double-stranded RNA in rice: a novel RNA replicon in plants," *Molecular & General Genetics*, 248(3):364-369 (1995).
Moriyama et al., "Stringently and developmentally regulated levels of a cytoplasmic double-stranded RNA and its high-efficiency transmission via egg and pollen in rice," *Plant Molecular Biology*, 31:713-719 (1996).

(56) References Cited

OTHER PUBLICATIONS

Morrissey et al., "Potent and persistent in vivo anti-HBV activity of chemically modified siRNAs," *Nat Biotechnol.* 23(8):1002-1007 (2005).
Moser et al., "Sequence- Specific Cleavage of Double Helical DNA by Triple Helix Formation," *Science*, 238:645-646 (1987).
Mount et al., "Gene and Metabolite Regulatory Network Analysis of Early Developing Fruit Tissues Highlights New Candidate Genes for the Control of Tomato Fruit Composition and Development," *Plant Physiology*, 149:1505-1528 (2009).
Non-Final Office Action dated Apr. 11, 2013, in U.S. Appl. No. 13/042,856.
Non-Final Office Action dated Aug. 19, 2016, in U.S. Appl. No. 13/612,925.
Non-Final Office Action dated Aug. 19, 2016, in U.S. Appl. No. 13/612,929.
Non-Final Office Action dated Apr. 29, 2016, in U.S. Appl. No. 13/583,302.
Non-Final Office Action dated Aug. 10, 2016, in U.S. Appl. No. 13/612,995.
Non-Final Office Action dated Aug. 12, 2015, in U.S. Appl. No. 13/612,936.
Non-Final Office Action dated Nov. 9, 2016, in U.S. Appl. No. 14/901,003.
Non-Final Office Action dated Aug. 13, 2015, in U.S. Appl. No. 13/612,929.
Non-Final Office Action dated Aug. 3, 2016, in U.S. Appl. No. 14/015,715.
Non-Final Office Action dated Aug. 5, 2016, in U.S. Appl. No. 14/015,785.
Non-Final Office Action dated Aug. 8, 2016, in U.S. Appl. No. 13/612,936.
Non-Final Office Action dated Dec. 17, 2015, in U.S. Appl. No. 14/532,596.
Non-Final Office Action dated Feb. 10, 2016, in U.S. Appl. No. 13/901,326.
Non-Final Office Action dated Feb. 23, 2016, in U.S. Appl. No. 14/603,347.
Non-Final Office Action dated Feb. 23, 2016, in U.S. Appl. No. 14/608,951.
Non-Final Office Action dated Sep. 6, 2016, in U.S. Appl. No. 14/335,135.
Non-Final Office Action dated Jul. 23, 2015, in U.S. Appl. No. 14/335,135.
Non-Final Office Action dated Jul. 30, 2014, in U.S. Appl. No. 13/042,856.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated Mar. 1, 2016, in U.S. Appl. No. 13/612,954.
Non-Final Office Action dated Mar. 30, 2015, in U.S. Appl. No. 13/583,302.
Non-Final Office Action dated May 15, 2015, in U.S. Appl. No. 14/608,951.
Non-Final Office Action dated May 22, 2015, in U.S. Appl. No. 13/612,985.
Non-Final Office Action dated Oct. 3, 2016, in U.S. Appl. No. 14/403,491.
Non-Final Office Action dated Sep. 1, 2015, in U.S. Appl. No. 13/612,954.
Non-Final Office Action dated Sep. 11, 2015, in U.S. Appl. No. 13/612,925.
Non-Final Office Action dated Sep. 4, 2015, in U.S. Appl. No. 13/612,995.
Nookaraju et al., "Molecular approaches for enhancing sweetness in fruits and vegetables," *Scientia Horticulture*, 127:1-15 (2010).
Nord-Larsen et al., "Cloning, characterization and expression analysis of tonoplast intrinsic proteins and glutamine synthetase in ryegrass (*Lolium perenne* L.)," *Plant Cell Reports*, 28(10):1549-1562 (2009).
Notice of Allowance dated Apr. 11, 2016, in U.S. Appl. No. 13/612,985.
Notice of Allowance dated Apr. 19, 2016, in U.S. Appl. No. 13/612,941.
Notice of Allowance dated Apr. 20, 2016, in U.S. Appl. No. 13/612,948.
Notice of Allowance dated Feb. 23, 2015, in U.S. Appl. No. 13/042,856.
Notice of Allowance dated Jun. 2, 2015, in U.S. Appl. No. 13/042,856.
Notice of Allowance dated Oct. 5, 2015, in U.S. Appl. No. 13/583,302.
Nowak et al., "A new and efficient method for inhibition of RNA viruses by DNA interference," *The FEBS Journal*, 276:4372-4380 (2009).
Office Action dated Apr. 13, 2016, in Chinese Patent Application No. 201280053985.3.
Office Action dated Aug. 28, 2013, in Chinese Patent Application No. 201180012795.2.
Office Action dated Jul. 18, 2016, in Indonesian Patent Application No. W00201203610.
Office Action dated Sep. 5, 2016, in Ukrainian Patent Application No. a 2014 03846.
Office Action dated Aug. 25, 2016, in Eurasian Patent Application No. 201201264.
Office Action dated Feb. 17, 2014, in Mexican Patent Application No. MX/a/2012/010479.
Office Action dated Feb. 24, 2014, in Eurasian Patent Application No. 201201264.
Office Action dated Jul. 23, 2015, in Ukrainian Patent Application No. 201211548.
Office Action dated Jun. 20, 2016, in Chinese Patent Application No. 201280054819.5.
Office Action dated Jun. 24, 2016, in Chinese Patent Application No. 201280053984.9.
Office Action dated Nov. 3, 2014, in Chinese Patent Application No. 201180012795.2.
Office Action dated Jan. 6, 2015, in Japanese Patent Application No. 2012-557165.
Office Action dated Nov. 19, 2014, in Eurasian Patent Application No. 201201264/28.
Office Action dated Oct. 5, 2015, in Eurasian Patent Application No. 201201264/28.
Ongvarrasopone et al., "A Simple and Cost Effective Method to Generate dsRNA for RNAi Studies in Invertebrates," *Science Asia*, 33:35-39 (2007).
Orbović et al., "Foliar-Applied Surfactants and Urea Temporarily Reduce Carbon Assimilation of Grapefruit Leaves," *J. Amer. Soc. Hort. Sci.*, 126(4):486-490 (2001).
Ouellet et al., "Members of the Acetohydroxyacid Synthase Muligene Family of Brassica Napus Have Divergent Patterns of Expression," *The Plant Journal*, Blackwell Scientific Publications, Oxford, GB, 2(3):321-330 (1992).
Paddison et al., "Stable suppression of gene expression by RNAi in mammalian cells," *Proc. Natl Acad. Sci. USA*, 99(3):1443-1448 (2002).
Palauqui et al., "Activation of systemic acquired silencing by localised introduction of DNA," *Current Biology*, 9:59-66 (1999).
Parera et al., "Dehydration Rate after Solid Matrix Priming Alters Seed Performance of Shrunken-2 Corn," *J. Amer. Soc. Hort. Sci.*, 119(3):629-635 (1994).
Partial Supplementary European Search Report dated Mar. 2, 2015, in European Patent Application No. 12 831 494.5.
Patent Examination Report No. 1 dated Feb. 8, 2016, in Australian Patent Application No. 2014262189.
Patent Examination Report No. 1 dated Jun. 17, 2016, in Australian Patent Application No. 2012308659.
Patent Examination Report No. 1 dated Jun. 17, 2016, in Australian Patent Application No. 2012308660.
Patent Examination Report No. 1 dated Nov. 11, 2013, in Australian Patent Application No. 2011224570.

(56) References Cited

OTHER PUBLICATIONS

Paungfoo-Lonhienne et al., "DNA is Taken up by Root Hairs and Pollen, and Stimulates Root and Pollen Tube Growth," *Plant Physiology*, 153:799-805 (2010).
Paungfoo-Lonhienne et al., "DNA uptake by *Arabidopsis* induces changes in the expression of CLE peptides which control root morphology," *Plant Signaling & Behavior*, 5(9):1112-1114 (2010).
Pei et al., "On the art of identifying effective and specific siRNAs," *Nature Methods*, 3(9):670-676 (2006).
Peretz et al., "A Universal Expression/Silencing Vector in Plants," *Plant Physiology*, 145:1251-1263 (2007).
Pornprom et al., "Glutamine synthetase mutation conferring target-site-based resistance to glufosinate in soybean cell selections," *Pest Manag Sci*, 2009; 65(2):216-222 (2009).
Pratt et al., "Amaranthus rudis and *A. tuberculatus*, One Species or Two?," *Journal of the Torrey Botanical Society*, 128(3):282-296 (2001).
Preston et al., "Multiple effects of a naturally occurring proline to threonine substitution within acetolactate synthase in two herbicide-resistant populations of *Lactuca serriola*," *Pesticide Biochem. Physiol.*, 84(3):227-235 (2006).
Promoter Prediction for SEQ ID No. 1702 from 13/612929/MK/, Promoter 2.0 Prediction Results, pp. 1-4 (2016).
Promoter Prediction for SEQ ID No. 4 from 13/612995/MK/, Promoter 2.0 Prediction Results, pp. 1-3 (2016).
Promoter Prediction for SEQ ID No. 7 from 13/612936/MK/, Promoter 2.0 Prediction Results, pp. 1-2 (2016).
Promoter Prediction for SEQ ID No. 8 from 13/612,925/MK/, Promoter 2.0 Prediction Results, pp. 1-6 (2016).
Qiwei,"Advance in DNA interference," *Progress in Veterinary Medicine*, 30(1):71-75 (2009).
Rajur et al., "Covalent Protein—Oligonucleotide Conjugates for Efficient Delivery of Antisense Molecules," *Bioconjug Chem.*, 8:935-940 (1997).
Reddy et al "Organosilicone Adjuvants Increased the Efficacy of Glyphosate for Control of Weeds in Citrus (Citrus spp.)" *HortScience* 27(9):1003-1005 (1992).
Reddy et al., "Aminomethylphosphonic Acid Accumulation in Plant Species Treated with Glyphosate," *J. Agric. Food Chem.*, 56(6):2125-2130 (2008).
Reither et al., "Specificity of DNA triple helix formation analyzed by a FRET assay," *BMC Biochemistry*, 3:27 (2002).
Restriction Requirement dated Apr. 21, 2015, in U.S. Appl. No. 13/612,954.
Restriction Requirement dated Feb. 12, 2015, in U.S. Appl. No. 13/612,985.
Restriction Requirement dated Jul. 15, 2016, in U.S. Appl. No. 14/143,748.
Restriction Requirement dated Jul. 18, 2016, in U.S. Appl. No. 14/143,836.
Restriction Requirement dated Mar. 12, 2015, in U.S. Appl. No. 13/612,948.
Restriction Requirement dated Mar. 4, 2015, in U.S. Appl. No. 13/612,941.
Restriction Requirement dated May 4, 2015, in U.S. Appl. No. 13/612,929.
Restriction Requirement dated May 5, 2015, in U.S. Appl. No. 13/612,936.
Restriction Requirement dated May 7, 2015, in U.S. Appl. No. 13/612,925.
Restriction Requirement dated May 7, 2015, in U.S. Appl. No. 13/612,995.
Restriction Requirement dated Oct. 2, 2012, in U.S. Appl. No. 13/042,856.
Restriction Requirement dated Oct. 13, 2016, in U.S. Appl. No. 14/206,707.
Restriction Requirement dated Oct. 21, 2014, in U.S. Appl. No. 13/583,302.
Restriction Requirement dated Oct. 28, 2015, in U.S. Appl. No. 14/603,347.
Restriction Requirement dated Sep. 2, 2015, in U.S. Appl. No. 14/532,596.
Rey et al., "Diversity of Dicotyledenous-Infecting Geminiviruses and Their Associated DNA Molecules in Southern Africa, Including the South-West Indian Ocean Islands," *Viruses*, 4:1753-1791 (2012).
Reynolds et al., "Rational siRNA design for RNA interference," *Nature Biotechnology*, 22:326-330 (2004).
Riggins et al., "Characterization of de novo transcriptome for waterhemp (*Amaranthus tuberculatus*) using GS-FLX 454 pyrosequencing and its application for studies of herbicide target-site genes," *Pest Manag. Sci.*, 66:1042-1052 (2010).
Roberts, "Fast-track applications: the potential for direct delivery of proteins and nucleic acids to plant cells for the discovery of gene function," *Plant Methods*, 1(12):1-3 (2005).
Robson et al., "Leaf senescence is delayed in maize expressing the Agrobacterium IPT gene under the control of a novel maize senescence-enhanced promoter," *Plant Biotechnology Journal*, 2:101-112 (2004).
Roitsch et al., "Extracellular invertase: key metabolic enzyme and PR protein," *Journal of Experimental Botany*, 54(382):513-524 (2003).
Roitsch et al., "Function and regulation of plant invertases: sweet sensations," *Trades in Plant Science*, 9(12):606-613 (2004).
Rose et al., "Functional polarity is introduced by Dicer processing of short substrate RNAs," *Nucleic Acids Research*, 33(13):4140-4156 (2005).
Rothnie et al., Pararetroviruses and Retroviruses: A Comparative Review of Viral Structure and Gene Expression Strategies, *Advances in Virus Research*, 44:1-67 (1994).
Ruan et al., "Suppression of Sucrose Synthase Gene Expression Represses Cotton Fiber Cell Initiation, Elongation, and Seed Development," *The Plant Cell*, 15:952-964 (2003).
Ryabov et al., "Cell-to-Cell, but Not Long-Distance, Spread of RNA Silencing That Is Induced in Individual Epidermal Cells," *Journal of Virology*, 78(6):3149-3154 (2004).
Ryan, "Human endogenous retroviruses in health and disease: a symbiotic perspective," *Journal of the Royal Society of Medicine*, 97:560-565 (2004).
Salanenka et al., "Seedcoat Permeability: Uptake and Post-germination Transport of Applied Model Tracer Compounds," *HortScience*, 46(4):622-626 (2011).
Santoro et al., "A general purpose RNA-cleaving DNA enzyme," *Proc. Natl. Acad. Sci. USA*, 94:4262-4266 (1997).
Sathasivan et al., "Nucleotide sequence of a mutant acetolactate synthase gene from an imidazolinone-resistant *Arabidopsis thaliana* var. Columbia," *Nucleic Acids Research*, 18(8):2188-2193 (1990).
Schönherr, "Water Permeability of Isolated Cuticular Membranes: The Effect of pH and Cations on Diffusion, Hydrodynamic Permeability and Size of Polar Pores in the Cutin Matrix," *Planta*, 128:113-126 (1976).
Schwab et al., "RNA silencing amplification in plants: Size matters," *PNAS*, 107(34):14945-14946 (2010).
Schweizer et al., "Double-stranded RNA interferes with gene function at the single-cell level in cereals," *The Plant Journal*, 24(6):895-903 (2000).
Schwember et al., "Drying Rates following Priming Affect Temperature Sensitivity of Germination and Longevity of Lettuce Seeds," *HortScience*, 40(3):778-781 (2005).
Scott et al., Botanical Insecticides for Controlling Agricultural Pests: Piperamides and the Colorado Potato Beetle *Leptinotarsa decemlineata* Say (Coleoptera: Chrysomelidae), *Archives of Insect Biochemistry and Physiology*, 54:212-225 (2003).
Second Chinese Office Action dated Jun. 10, 2014, in Chinese Patent Application No. 201180012795.2.
Second Office Action dated Feb. 25, 2016, in Chinese Patent Application No. 201280054179.8.
Second Office Action dated Mar. 4, 2016, in Chinese Patent Application No. 201280054820.8.
Seidman et al., "The potential for gene repair via triple helix formation," *J Clin Invest.*, 112(4):487-494 (2003).

(56) References Cited

OTHER PUBLICATIONS

Selvarani et al., "Evaluation of seed priming methods to improve seed vigour of onion (*Allium cepa cv. Aggregatum*) and carrot (*Daucus carota*)," *Journal of Agricultural Technology*, 7(3):857-867 (2011).
Senthil-Kumar et al., "A systematic study to determine the extent of gene silencing in Nicotiana benthamiana and other Solanaceae species when heterologous gene sequences are used for virus-induced gene silencing," *New Phytologist*, 176:782-791 (2007).
Sharma et al., "A simple and efficient *Agrobacterium*-mediated procedure for transformation of tomato," *J. Biosci.*, 34(3):423 433 (2009).
Shintani et al., "Antisense Expression and Overexpression of Biotin Carboxylase in Tobacco Leaves," *Plant Physiol.*, 114:881-886 (1997).
Showalter, "Structure and Function of Plant Cell Wall Proteins," *The Plant Cell*, 5:9-23 (1993).
Sijen et al., "On the Role of RNA Amplification in dsRNA-Triggered Gene Silencing," *Cell*, 107:465-476 (2001).
Silwet L-77 Spray Adjuvant for agricultural applications, product description from Momentive Performance Materials, Inc. (2003).
Singh et al., "Absorption and translocation of glyphosate with conventional and organosilicone adjuvants," *Weed Biology and Management*, 8:104-111 (2008).
Snead et al., "Molecular basis for improved gene silencing by Dicer substrate interfering RNA compared with other siRNA variants," *Nucleic Acids Research*, 41(12):6209-6221 (2013).
Song et al., "Herbicide," *New Heterocyclic Pesticide*, Chemical Industry Press, 354-356 (2011).
Steeves et al., "Transgenic soybeans expressing siRNAs specific to a major sperm protein gene suppress *Heterodera glycines* reproduction," *Funct. Plant Biol.*, 33:991-999 (2006).
Stevens et al., "New Formulation Technology—Silwet® Organosilicone Surfactants Have Physical and Physiological Properties Which Enhance the Performance of Sprays," *Proceedings of the 9th Australian Weeds Conference*, pp. 327-331 (1990).
Stevens, "Organosilicone Surfactants as Adjuvants for Agrochemicals," *Journal of Pesticide Science*, 38:103-122 (1993).
Stock et al., "Possible Mechanisms for Surfactant-Induced Foliar Uptake of Agrochemicals," *Pestic. Sci.*, 38:165-177 (1993).
Strat et al., "Specific and nontoxic silencing in mammalian cells with expressed long dsRNAs," *Nucleic Acids Research*, 34(13):3803-3810 (2006).
Street, "Why is DNA (and not RNA) a stable storage form for genetic information?," *Biochemistry Revisited*, pp. 1-4 (2008).
Sudarsan et al., "Metabolite-binding RNA domains are present in the genes of eukaryotes," *RNA*, 9:644-647 (2003).
Sun et al., "A Highly efficient Transformation Protocol for Micro-Tom, a Model Cultivar for Tomato Functional Genomics," *Plant Cell Physiol.*, 47(3):426-431 (2006).
Sun et al., "Sweet delivery—sugar translocators as ports of entry for antisense oligodeoxynucleotides in plant cells," *The Plant Journal*, 52:1192-1198 (2007).
Sutton et al., "Activity of mesotrione on resistant weeds in maize," *Pest Manag. Sci.*, 58:981-984 (2002).
Takasaki et al., "An Effective Method for Selecting siRNA Target Sequences in Mammalian Cells," *Cell Cycle*, 3:790-795 (2004).
Tang et al., "Efficient delivery of small interfering RNA to plant cells by a nanosecond pulsed laser-induced stress wave for post-transcriptional gene silencing," *Plant Science*, 171:375-381 (2006).
Tank Mixing Chemicals Applied to Peanut Crops: Are the Chemicals Compatible?, College of Agriculture & Life Sciences, NC State University, AGW-653, pp. 1-11 (2004).
Taylor, "Seed Storage, Germination and Quality," *The Physiology of Vegetable Crops*, pp. 1-36 (1997).
Temple et al., "Can glutamine synthetase activity levels be modulated in transgenic plants by the use of recombinant DNA technology?" *Transgenic Plants and Plant Biochemistry*, 22(4):915-920 (1994).
Temple et al., "Down-regulation of specific members of the glutamine synthetase gene family in Alfalfa by antisense RNA technology," *Plant Molecular Biology*, 37:535-547 (1998).
Templeton et al., "Improved DNA: liposome complexes for increased systemic delivery and gene expression," *Nature Biotechnology*, 15:647-652 (1997).
Tenllado et al., "Crude extracts of bacterially expressed dsRNA can be used to protect plants against virus infection," *BMC Biotechnology*, 3(3):1-11 (2003).
Tenllado et al., "Double-Stranded RNA-Mediated Interference with Plant Virus Infection," *Journal of Virology*, 75(24):12288-12297 (2001).
Tenllado et al., "RNA interference as a new biotechnological tool for the control of virus diseases in plants," *Virus Research*, 102:85-96 (2004).
Tepfer, "Risk assessment of virus resistant transgenic plants," *Annual Review of Phytopathology*, 40:467-491 (2002).
The Seed Biology Place, Website Gerhard Leubner Lab Royal Holloway, University of London, <http://www.seedbiology.de/seedtechnology.asp.
Third Party Submission filed on Nov. 29, 2012 in U.S. Appl. No. 13/042,856.
Thomas et al., "Size constraints for targeting post-transcriptional gene silencing and for RNA-directed methylation in *Nicotiana benthamiana* using a potato virus X vector," *The Plant Journal*, 25(4):417-425 (2001).
Thompson, et al., "CLUSTAL W: improving the sensitivity of progressive multiple sequence alignment through sequence weighting, position-specific gap penalties and weight matrix choice," *Nucl. Acids Res.*, 22(22):4673-4680 (1994).
Timmons et al., "Specific interference by ingested dsRNA," *Nature*, 395:854 (1998).
Tomari et al., "Perspective: machines for RNAi," *Genes & Dev.*, 19:517-529 (2005).
Tomlinson et al., "Evidence that the hexose-to-sucrose ratio does not control the switch to storage product accumulation in oilseeds: analysis of tobacco seed development and effects of overexpressing apoplastic invertase," *Journal of Experimental Botany*, 55(406):2291-2303 (2004).
Töpfer et al., "Uptake and Transient Expression of Chimeric Genes in Seed-Derived Embryos," *Plant Cell*, 1:133-139 (1989).
Tran et al., "Control of specific gene expression in mammalian cells by co-expression of long complementary RNAs," *FEBS Lett.*;573(1-3):127-134 (2004).
Tranel et al., "Resistance of weeds to ALS-inhibiting herbicides: what have we learned?," *Weed Science*, 50:700-712 (2002).
Tsugawa et al., "Efficient transformation of rice protoplasts mediated by a synthetic polycationic amino polymer," *Theor Appl Genet*, 97:1019-1026 (1998).
Turina et al., "Tospovimses in the Mediterranean Area," *Advances in Virus Research*, 84:403-437 (2012).
Tuschl, "Expanding small RNA interference," *Nature Biotechnol.*, 20: 446-448 (2002).
Tuschl, "Rna Interference and Small Interfering RNAs," *ChemBiochem.* 2(4):239-245 (2001).
Ui-Tei et al., "Guidelines for the selection of highly effective siRNA sequences for mammalian and chick RNA interference," *Nucleic Acids Res.*, 32(3): 936-948.
Unnamalai et al., "Cationic oligopeptide-mediated delivery of dsRNA for post-transcriptional gene silencing in plant cells," *FEBS Letters*, 566:307-310 (2004).
Unnimman et al., "Alternate Paradigm for Intrinsic Transcription Termination in Eubacteria," *The Journal of Biological Chemistry*, 276(45)(9):41850-41855 (2001).
Unnimman et al., "Conserved Economics of Transcription Termination in Eubacteria," *Nucleic Acids Research*, 30(3):675-684 (2002).
Urayama et al., "Knock-down of OsDCL2 in Rice Negatively Affects Maintenance of the Endogenous dsRNA Virus, *Oryza sativa* Endornavirus," *Plant and Cell Physiology*, 51(1):58-67 (2010).
Van de Wetering et al., "Specific inhibition of gene expression using a stably integrated, inducible small-interfering-RNA vector," *EMBO Rep.*, 4(6):609-615 (2003).

(56) References Cited

OTHER PUBLICATIONS

Vasil et al., "Herbicide Resistant Fertile Transgenic Wheat Plants Obtained by Microprojectile Bombardment of Regenerable Embryogenic Callus," *Bio/Technology*,10:667-674 (1992).
Vaucheret, "Post-transcriptional small RNA pathways in plants: mechanisms and regulations," *Genes Dev.*, 20:759-771 (2006).
Vencill et al., "Resistance of Weeds to Herbicides," *Herbicides and Environment*, 29:585-594 (2011).
Verma et al., "Modified oligonucleotides: synthesis and strategy for users," *Annu. Rev. Biochem.*, 67:99-134 (1998).
Vermeulen et al., "The contributions of dsRNA structure to Dicer specificity and efficiency,"*RNA*, 11(5):674-682 (2005).
Vert et al., "An accurate and interpretable model for siRNA efficacy prediction," *BMC Bioinformatics*, 7:520 (2006).
Voinnet et al., "Systemic Spread of Sequence-Specific Transgene RNA Degradation in Plants is Initiated by Localized Introduction of Ectopic Promoterless DNA," *Cell*, 95:177-187 (1998).
Wakelin et al., "A target-site mutation is present in a glyphosate-resistant *Lolium rigidum* population," *Weed Res. (Oxford)*, 46(5):432-440 (2006).
Walton et al., "Prediction of antisense oligonucleotide binding affinity to a structured RNA target," *Biotechnol Bioeng* 65(1):1-9 (1999).
Wan et al., "Generation of Large Numbers of Independently Transformed Fertile Barley Plants," *Plant Physiol.*, 104:37-48 (1994).
Wang et al., "Foliar uptake of pesticides-Present status and future challenge," ScienceDirect, 87:1-8 (2007).
Wardell, "Floral Induction of Vegetative Plants Supplied a Purified Fraction of Deoxyribonucleic Acid from Stems of Flowering Plants," *Plant Physiol*, 60:885-891 (1977).
Wardell,"Floral Activity in Solutions of Deoxyribonucleic Acid Extracted from Tobacco Stems," *Plant Physiol*, 57:855-861 (1976).
Waterhouse et al., "Virus resistance and gene silencing in plants can be induced by simultaneous expression of sense and antisense RNA," *Proc Natl Acad Sci USA*, 95 13959-13964 (1998).
Welch et al., "Expression of ribozymes in gene transfer systems to modulate target RNA levels," *Curr Opin Biotechnol.* 9(5):486-496 (1998).
Widholm et al., "Glyphosate selection of gene amplification in suspension cultures of 3 plant species," *Phyisologia Plantarum*, 112:540-545 (2001).
Wiesman et al., "Novel cationic vesicle platform derived from vernonia oil for efficient delivery of DNA through plant cuticle membranes," *Journal of Biotechnology*, 130:85-94 (2007).
Wilson, et al., "Transcription termination at intrinsic terminators: The role of the RNA hairpin," *Proc. Natl. Acad. Sci. USA*, 92:8793-8797 (1995).
Winkler et al., "Thiamine derivatives bind messenger RNAs directly to regulate bacterial gene expression," *Nature*, 419:952-956 (2002).
Written Opinion dated Apr. 7, 2016, in Singapore Patent Application No. 201206152-9.
Written Opinion dated May 8, 2014, in International Application No. PCT/IL2013/050447.
Written Opinion dated Sep. 1, 2014, in Singapore Patent Application No. 201206152-9.
Xu et al., Characterization and Functional Analysis of the Calmodulin-Binding Domain of Rac1 GTPase, *Plos One*, 7(8)1-12:e42975 (2012).
Yin et al., "Production of double-stranded RNA for interference with TMV infection utilizing a bacterial prokaryotic expression system," *Appl. Microbiol. Biotechnol.*, 84(2):323-333 (2009).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," *PNAS*, 98(12):6617-6622 (2001).
Zhang et al., "A novel rice gene, NRR responds to macronutrient deficiency and regulates root growth," *Mol Plant*, 5(1):63-72 (2012).
Zhang et al., "*Agrobacterium*-mediated transformation of *Arabidopsis thaliana* using the floral dip method," *Nature Protocols*, 1(2):1-6 (2006).
Zhang et al., "Cationic lipids and polymers mediated vectors for delivery of siRNA," *Journal of Controlled Release*, 123:1-10 (2007).
Zhang et al., "Chapter 10: New Characteristics of Pesticide Research & Development," *New Progress of the world agriculture chemicals*, pg. 209 (2010).
Zhang et al., "DEG: a database of essential genes," *Nucleic Acids Res.*, 32:D271-D272 (2004).
Zhang et al., "Transgenic rice plants produced by electroporation-mediated plasmid uptake into protoplasts," *The Plant Cell Rep.*, 7:379-384 (1988).
Zhao et al.,"*Phyllotreta striolata* (Coleoptera: Chrysomelidae):Arginine kinase cloning and RNAi-based pest control," *European Journal of Entomology*, 105(5):815-822 (2008).
Zhu et al., "Ingested RNA interference for managing the populations of the Colorado potato beetle, *Leptinotarsa decemlineata*," *Pest Manag Sci*, 67:175-182 (2010).
Anonymous, "Resistant Weeds Spur Research Into New Technologies," Grains Research & Development Corporation, 2013.
Bauer et al., "The major protein import receptor of plastids is essential for chloroplast biogenesis," Nature, 403:203-207 (2000).
Baum et al., "Progress Towards RNAi-Mediated Insect Pest Management" Advances in Insect Physiology, 47:249-295 (2014).
Burgos et al., "Review: Confirmation of Resistance to Herbicides and Evaluation of Resistance Levels," Weed Science, 61 (1):4-20 (2013).
Chang et al., "Dual-target gene silencing by using long, sythetic siRNA duplexes without triggering antiviral responses," Molecules and Cells, 27(6)689-695 (2009).
Cheng et al., "Transient Expression of Minimum Linear Gene Cassettes in Onion Epidermal Cells Via Direct Transformation," Appl Biochem Biotechnol, 159:739-749 (2009).
Christiaens et al., "The challenge of RNAi-mediated control of hemipterans," Current Opinion in Insect Science, 6:15-21 (2014).
Communication Pursuant to Article 94(3) EPC dated Sep. 5, 2018, in European Patent Application No. 17152830.0.
Database EMBL XP-002781749(BG442539) dated Mar. 20, 2001.
Egli et al., "A Maize Acetyl-Coenzyme A Carboxylase cDNA Sequence," Plant Physiol., 108: 1299-1300 (1995).
Eudes et al., "Cell-penetrating peptides," Plant Signaling & Behavior, 3(8):549-5550 (2008).
European Search Report dated Jun. 29, 2018, in European Patent Application No. 18157745.3.
European Search Report dated Sep. 7, 2017, in European Patent Application No. 17152830.0.
Examination Report dated Mar. 1, 2018, in Australian Patent Application No. 2013264742.
Extended European Search Report dated Nov. 7, 2017, in European Patent Application No. 15811092.4.
Extended European Search Report dated Nov. 8, 2017, in European Patent Application No. 15737282.2.
Extended European Search Report dated Sep. 28, 2018, in European Patent Application No. 16740770.9.
Extended European Search Report dated Apr. 13, 2018, in European Patent Application No. 15812530.0.
Extended European Search Report dated Mar. 15, 2018, in European Patent Application No. 17181861.0.
Fridlund, "Distribution of Chlorotic Leaf Spot Virus in Apple Budsticks," Plant Disease Reporter, 57(10): 865-869 (1973).
Gallie et al., "Identification of the motifs within the tobacco mosaic virus 5'-leader responsible for enhancing translation," Nucleic Acids Res., 20(17):4631-4638 (1992).
Gan et al., "Bacterially expressed dsRNA protects maize against SCMV infection," Plant Cell Rep, 29(11):1261-1268 (2010).

(56) References Cited

OTHER PUBLICATIONS

Gasser et al., "Structure, Expression, and Evolution of the 5-Enolpyruvylshikimate-3-phosphate Synthase Genes of Petunia and Tomato," J. Biol. Chem., 263: 4280-4287 (1988).
Gilmer et al., "Latent Viruses of Apple I. Detection with Woody Indictors," NY St. Agr. Exp. Sta. (Geneva)), 1(10):1-9 (1971).
Gomez-Zurita et al., "Recalibrated Tree of Leaf Beetles (Chrysomelidae) Indicates Independent Diversification of Angiosperms and Their Insect Herbivores," PLoS One, 4(e360):1-8 (2007).
Hoermann et al., "Tic32, as Essential Component in Chloroplast Biogenesis," The Journal of Biological Chemistry, 279(33):34756-34762 (2004).
Hu et al., "High efficiency transport of quantum dots into plant roots with the aid of silwet L-77," Plant Physiology and Biochemistry, 48:703-709 (2010).
Inaba et al., "Arabidopsis Tic110 is Essential for the Assembly and Function of the Protein Import Machinery of Plastids," The Plant Cell, 17:1482-1496 (2005).
Jarvis et al, "An *arabidopsis* mutant defective in the plastid general protein import apparatus," Science, 282:100-103 (1998).
Kovacheva et al., "Further in vivo studies on the role of the molecular chaperone, Hsp93, in plastid protein import," The Plant Journal, 50:364-379 (2007).
Kovacheva et al., "In vivo studies on the roles of Tic100, Tic40 and Hsp93 during chloroplast protein import," The Plant Journal, 41:412-428 (2005).
Li et al., "Long dsRNA but not siRNA initiates RNAi in western corn rootworm larvae and adults," Journal of Applied Entomology, 139(6):432-445 (2015).
Liu "Calmodulin and Cell Cycle," Foreign Medical Sciences Section of Pathophysiology and Clinical Medicine, 18(4):322-324 (1998).
Liu, "The Transformation of Nucleic Acid Degradants in Plants," China Organic Fertilizers, Agriculture Press, ISBN: 7-1091634 (with English translation) (1991).
Németh, "The Virus, Mycoplasma and Rickettsia Diseases of Fruit Trees," Martinus Nijhoff Publishers, The Netherlands and Akadémai Kiadó, Hungary, pp. 197-204 (1986).
Non-Final Office Action dated Mar. 21, 2018, in U.S. Appl. No. 13/619,980.
Office Action dated Aug. 9, 2018, in Canadian Patent Application No. 2,848,371.
Office Action dated Dec. 5, 2017, in Japanese Patent Application No. 2016-502033.
Office Action dated Feb. 21, 2018, in Mexican Patent Application No. MX/a/2015/012632 (with English translation).
Office Action dated Jul. 30, 2018, in Canadian Patent Application No. 2,848,576.
Office Action dated Mar. 8, 2018 (with English translation), in Chilean Patent Application No. 201403192.
Paddison et al., "Stable suppression of gene cells," Proc. Natl Acad. Sci. USA, 99(3):1443-1448 (2002).
Partial European Search Report dated Dec. 6, 2017, in European Patent Application No. 17181861.0.
Partial Supplementary European Search Report dated Jan. 11, 2018, in European Patent Application No. 15812530.0.
Qichuan et al., Seed Science, China Agriculture Press, pp. 101-103, Tables 2-37 (2001).
Reverdatto et al., "A Multisubunit Acetyl Coenzyme A Carboxylase from Soybean," Plant Physiol., 119: 961-978 (1999).
Search Report dated Oct. 20, 2017, in Chinese Patent Application No. 201380039346.6.
Stevens, "Formulation of Sprays to Improve the Efficacy of Foliar Fertilisers," *New Zealand Journal of Forestry Science*, 24(1):27-34 (1994).
Summons to Attend Oral Proceedings Pursuant to Rule 115(1) EPC, dated Aug. 7, 2017, in European Patent Application No. 12832160.1.

Sun et al., "Antisense oligodeoxynucleotide inhibition as a potentstrategy in plant biology: identification of SUSIBA2 as a transcriptional activator in plant sugar signalling," The Plant Journal, 44:128-138 (2005).
Teng et al., "Tic21 Is an Essential Translocon Component for Protein Translocation across the Chloroplast Inner Envelope Membrane," The Plant Cell, 18:2247-2257 (2006).
Tice, "Selecting the Right Compounds for Screening does Lipinksi's Rule of 5 for Pharmaceuticals Apply to Agrochemicals?," *Pest Manag Sci.* 57:3-16 (2001).
Ulrich et al., "Large scale RNAi screen in Tribolium reveals novel target genes for pest control and the proteasome as prime target," BMC genomics, 16(1):671 (2015).
Xu et al., "Characterization and Functional Domain of Rac1 GTPase," PLoS One, 7(8):e42975 (2012).
Zaimin et al., Chapter III Seeds and Seedlings, Botany, Northwest A&F University Press, pp. 87-92 (2009).
Zhang et al., "Development and Validation of Endogenous Reference Genes for Expression Profiling of Medaka (Oryzias latipes) Exposed to Endocrine Disrupting Chemicals by Quantitative Real-Time RT-PCR," Toxicological Sciences, 95(2):356-368 (2007).
Zhang, Chapter 10: New Characteristics of Pesticide Research & Development, p. 209 (2010).
Zhong et al., "A pea antisense gene for the chloroplast stromal processing peptidase yields seedling lethals in *Arabidopsis*: survivors show defective GFP import in vivo," The Plant Journal, 34:802-812 (2003).
Zotti et al., "RNAi technology for insect management and protection of beneficial insects from diseases: lessons, challenges and risk assessments," Neotropical Entomology, 44(3):197-213 (2015).
Asad et al., "Silicon Carbide Whisker-mediated Plant Transformation," Properties and Applications of Silicon Carbide, pp. 345-358 (2011).
Baulcombe, "RNA silencing in plants," Nature, 431:356-363 (2004).
Belhadj et al., "Methyl Jasmonate Induces Defense Responses in Grapevine and Triggers Protection against Erysiphe necator," J. Agric Food Chem., 54:9119-9125 (2006).
Cong et al., "Multiplex Genome Engineering Using CRISPR/Cas Systems," Science, 339:819-823 (2013).
Declaration of Jerzy Zabkiewicz executed Nov. 28, 2017, as filed by Opponent in Australian Patent Application No. 2014262189, pp. 1-73.
Declaration of Jerzy Zabkiewicz executed Nov. 28, 2017, as filed by Opponent in Australian Patent Application No. 2014262189, pp. 1-4.
Declaration of Neena Mitter executed Nov. 30, 2017, as filed by Opponent in Australian Patent Application No. 2014262189, pp. 1-114.
Declaration of Neena Mitter executed Nov. 30, 2017, as filed by Opponent in Australian Patent Application No. 2014262189, pp. 1-25.
Delye et al., "PCR-based detection of resistance to acetyl-CoA carboxylase-inhibiting herbicides in black-grass (Alopecurus myosuroides Huds) and ryegrass (Lolium rigidum Gaud)," Pest Management Science, 58:474-478 (2002).
Delye et al., "Variation in the gene encoding acetolactate-synthase in Lolium species and proactive detection of mutant, herbicide-resistant alleles," Weed Research, 49:326-336 (2009).
Desveaux et al., "PBF-2 Is a Novel Single-Stranded DNA Binding Factor Implicated in PR-10a Gene Activation in Potato," The Plant Cell, 12:1477-1489 (2000).
Dietzgen et al., "Transgenic gene silencing strategies for virus control," Australasian Plant Pathology, 35:605-618 (2006).
Dilpreet et al., "Glyphosate Rsistance in a Johnsongrass (Sorghum halepense) Biotype from Arkansas," Weed Science, 59(3):299-304 (2011).
Drobyazko R.V. "Reliable and environmentally friendly insecticide," Protection and quarantine of plants, 2012 (pp. 52, 53) (in Russian).
Duhoux et al., "Reference Genes to Study Herbicide Stress Response in Lolium sp.: Up-Regulation of P3450 Genes in Plants Resistant to Acetolactate-Synthase Inhibitors," Plos One, 8(5):e63576 (2013).

(56) References Cited

OTHER PUBLICATIONS

Extended European Search Report dated Dec. 19, 2018, in European Patent Application No. 16804395.8.
Extended European Search Report dated Nov. 21, 2018, in European Patent Application No. 18175809.5.
Extended European Search Report dated Nov. 16, 2018, in European Patent Application No. 18182238.8.
Gao et al., "DNA-guided genome editing using the Natronobacterium gregoryi Argonaute," Nature Biotechnology, 34(7):768-773 (2016).
Guttieri et al., "DNA Sequence Variation in Domain A of the Acetolactate Synthase Genes of Herbicide-Resistant and -Susceptible Weed Biotypes," Weed Science, 40:670-679 (1992).
Horsch et al., "Inheritance of Functional Foreign Genes in Plants ," Science, 223:496-498 (1984).
Hsu et al., "DNA targeting specificity of RNA-guided Cas9 nucleases," Nature Biotechnology, 31:827-832 (2013).
Huggett et al., "Real-time RT-PCR normalisation, strategies and considerations," Genes and Immunity, 6:279-284 (2005).
International Search Report dated Oct. 13, 2016, in International Patent Application No. PCT/US2016/35500.
Jiang et al., Chapter III Seeds and Seedlings, Botany, Northwest A&F University Press, pp. 87-92 (2009).
Kim et al., "Synthesis and characterization of mannosylated pegylated polyethylenimine as a carrier for siRNA," International Journal of Pharmaceutics, 427:123-133 (2012).
Kirkwood, "Recent developments in our understanding of the plant cuticle as a barrier to the foliar uptake of pesticides," Pestic Sci, 55:69-77 (1999).
Kumar et al., "Sequencing, De Novo Assembly and Annotation of the Colorado Potato Beetle, Leptinotarsa decemlineata,Transcriptome," PLoS One, 9(1):e86012 (2014).
Liu, "The Transformation of Nucleic Acid Degradants in Plants," China Organic Fertilizers, Agriculture Press, ISBN: 7-1091634 (1991) (with English translation).
Liu, "Confocal laser scanning microscopy—an attractive tool for studying the uptake of xenobiotics into plant foliage," Journal of Microscopy, 213 (Pt 2):87-93 (2004).
Lodish et al., Molecular Cell Biology, Fourth Edition, p. 210 (2000).
Lucas et al., "Plasmodesmata—bridging the gap between neighboring plant cells," Trends in Cell Biology, 19:495-503 (2009).
Masoud, "Constitutive expression of an inducible β-1,3 -glucanase in alfalfa reduces disease severity caused by the oomycete pathogen Phytophthora megasperma f. sp medicaginis . . .," Trans Res, 5:313-323 (1996).
Misawa, "Expression of an Erwinia phytoene desaturase gene not only confers multiple resistance to herbicides interfering with carotenoid biosynthesis but also alters xanthophyll metabolism..," The Plant Jrnl, 6(4):481-489 (1994).
Misawa, "Functional expression of the Erwinia uredovora carotenoid biosynthesis gene crtI in transgenic plants showing an increase of β-carotene biosynthesis activity and resistance . . . ," The Plant Jrnl, 4(5):833 -840 (1993).
Morozov et al., "Evaluation of Preemergence Herbicides for Control of Diclofop- resistant Italian Ryegrass (Lolium multiflorum) in Virginia," Virginia Polytechnic Institute and State University, pp. 43-71 (2004).
N-TER Nanoparticle siRNA, Sigma Aldrich TM website, Web. Nov. 20, 2018.
Office Action dated Sep. 20, 2018, in Chilean Patent Application No. 201601440 (with English translation).
Pratt et al., "Sorghum Expressed Sequence Tags Identify Signature Genes for Drought, Pathogenesis, and Skotomorphogenesis from a Milestone Set of 16,801 Unique Transcripts," Plant Physiology, 139:869-884 (2005).
Partial Supplementary European Search Report dated Jan. 11, 2018, in European Patent Application No. 15812530.2.
Partial European Search Report dated Jun. 29, 2018, in European Patent Application No. 18157745.3.
Qi et al., "RNA processing enables predictable programming of gene expression," Nature Biotechnology, 30:1002-1007 (2012).
Regalado, "The Next Great GMO Debate," MIT Technology Review, pp. 1-19 (2015).
Riar et al., "Glyphosate Resistance in a Johnsongrass (Sorghum halepense) Biotype from Arkansas," Weed Science, 59:299-304 (2011).
Schönherr et al., "Size selectivity of aqueous pores in astomatous cuticular membranes isolated from Populus canescens (Aiton) Sm. Leaves," Planta, 219:405-411 (2004).
Simeoni et al., "Insight into the mechanism of the peptide-based gene delivery system MPG: implications for delivery of siRNA into mammalian cells," Nucleic Acids Research, 31(11):2717-2724 (2003).
Swarts et al., "DNA-guided DNA interference by a prokaryotic Argonaute," Nature, 507(7491):258-61 (2014).
Swarts et al., "Argonaute of the archaeon Pyrococcus furiosus is a DNA-guided nuclease that targets cognate DNA," Nucleic Acid Res., 43(10):5120-5129 (2015).
Tomlinson, "Evidence that the hexose-to-sucrose ratio does not control the switch to storage product accumulation in oilseeds: analysis of tobacco seed development and effects . . . ," Jrnl of Exper Bot, 55(406):2291-2303 (2004).
Toriyama et al., "Transgenic Rice Plants After Direct Gene Transfer Into Protoplasts," Bio/Technology, 6:1072-1074 (1988).
Townsend et al., "High frequency modification of plant genes using engineered zinc finger nucleases," Nature, 459:442-445 (2009).
TransIT-TKO® Transfection Reagent, Frequently Asked Questions, Web. 2019.
Van der Meer et al., "Promoted analysis of the chalcone synthase (chs A) gene of Petunia hybrid: a 67 bp promoter region directs flower-specific expression," Plant Mol. Biol., 15:95-109 (1990).
Vila-Aiub et al., "Glyphosate resistance in perennial Sorghum halepense (Johnsongrass), endowed by reduced glyphosate translocation and leaf uptake," Pest Manag Sci, 68:430-436 (2012).
Yan et al., Seed Science, China Agriculture Press, pp. 101-103, Tables 2-37 (2001).
Yu et al., "Glyphosate, paraquat and ACCase multiple herbicide resistance evolved in a Lolium rigidum biotype," Planta, 225:499-513 (2007).
Yu et al., "Diversity of Acetyl-Coenzyme A Carboxylase Mutations in Resistant Lolium Populations: Evaluation Using Clethodim," (2007) Plant Physiology, 145:547-558 (2007).
Zabkiewicz, "Adjuvants and herbicidal efficacy—present status and future prospects," Weed Research, 40:139-149 (2000).
Zhao et al., "PsOr1, a potential target for RNA interference-based pest management," Insect Molecular Biology, 20(1):97-104 (2011).
Zhao et al., "Vegetable Standardized Production Technology," Hangzhou: Zhejiang Science and Technology Press, p. 19 (2008).
Zhang et al., "Progress in research of honey bee mite Varro destructor," Journal of Environmental Entomology, 34(3):345-353 (2012).
Zidack et al., "Promotion of Bacterial Infection of Leaves by an Organosilicone Surfactant: Implications for Biological Weed Control," Biological Control, 2:111-117 (1992).
Zipperian et al., "Silicon Carbide Abrasive Grinding," Quality Matters Newsletter, PACE Technologies 1(2):1-3 (2002).
Andersen et al., "Delivery of siRNA from lyophilized polymeric surfaces," Biomaterials, 29:506-512 (2008).
Baker, "Chlorophyll Fluorescence: A Probe of Photosynthesis In Vivo," Annu. Rev. Plant Biol., 59:89-113 (2008).
Brugiere et al., "Glutamine Synthetase in the Phloem Plays a Major Role in Controlling Proline Production," The Plant Cell, 11:195-2011 (1999).
Burleigh, "Relative quantitative RT-PCR to study the expression of plant nutrient transporters in arbuscular mycorrhizas," Plant Science, 160:899-904 (2001).
Chang et al., "Dual-target gene silencing by using long, synthetic siRNA duplexes without triggering antiviral responses," Molecules and Cells, 27(6):689-695 (2009).
Communication pursuant to Article 94(3) EPC dated Mar. 16, 2020, in European Patent Application No. 17194281.6.
Communication pursuant to Article 94(3) EPC dated Mar. 27, 2020, in European Patent Application No. 15811092.4.

(56) References Cited

OTHER PUBLICATIONS

Danka et al., "Field Test of Resistance to Acarapis woodi (Acari: Tarsonemidae) and of Colony Production by Four Stocks of Honey Bees (Hymenoptera: Apidae)" *Journal of Economic Entomology*, 88(3):584-591 (1995).
Decision to Grant dated Feb. 24, 2020, in Ukrainian Patent Application No. a 2016 08743 (with English language translation).
Declaration of Professor Robert James Henry executed Mar. 1, 2018, as filed by Applicant in Australian Patent Application No. 2014262189, pp. 1-119.
Downey et al., "Single and dual parasitic mite infestations on the honey bee, Apis mellifera L.," *Insectes Sociaux*, 47(2):171-176 (2000).
Drobyazko R.V., "Reliable and environmentally friendly insecticide," Protection and quarantine of plants, 2012 (pp. 52, 53) (with English translation).
Extended European Search Report dated Mar. 25, 2020, in European Patent Application No. 19192942.1.
Gilmer et al., "Latent Viruses of Apple I. Detection with Woody Indicators," *Plant Pathology*, 1(10):1-9 (1971).
Hörmann et al., "Tic32, as Essential Component in Chloroplast Biogenesis," *The Journal of Biological Chemistry*, 279(33):34756-34762 (2004).
Hwa et al., "Fixation of hybrid vigor in rice: opportunities and challenges," *Euphytica*, 160:287-293 (2008).
Jasieniuk et al., "Glyphosate-Resistant Italian Ryegrass (Lolium multiflorum) in California: Distribution, Response to Glyphosate, and Molecular Evidence for an Altered Target Enzyme," *Weed Science*, 56(4):496-502 (2008).
Khanbekova et al., The defeat of the honey bee apis melifera caucasica Gorb. By viruses and parasites, and condition of bee colonies in different ecogeographical conditions of Greater Caucasus, *Agricultural Biology*. 2013 (p. 43) (in Russian).
Li et at., "Long dsRNA but not siRNA initiates RNAi in western corn rootworm larvae and adults," *Journal of Applied Entomology*, 139(6):432-445 (2015).
Nemeth, "Virus, mycoplasma and rickettsia diseases of fruit trees," *Martinus Nijhoff Publishers*, 197-204 (1986).
N-TER Nanoparticle siRNA, Sigma Aldrich TM website, Web. Nov. 20, 2018 <https://www.sigmaaldrich.com/life-science/custom-oligos/sirna-oligos/n-ter-nanoparticle.html>.
Office Action dated Feb. 20, 2020, in Canadian Patent Application No. 2,905,104.
Office Action dated Feb. 25, 2020, in Japanese Patent Application No. 2017-538699 (with English language translation).

Ossowski et al., "Gene silencing in plants using artificial microRNAs and other small RNAs," *The Plant Journal*, 53:674-690 (2008).
Partial European Search Report dated Dec. 6, 2019, in European Patent Application No. 19185431.4.
Prado et al., "Design and optimization of degenerated universal primers for the cloing of the plant acetolactate synthase conserved domains," *Weed Science*, 52:487-491 (2004).
Regalado, "The Next Great GMO Debate," MIT Technology Review, pp. 1-19 (2015) <https://www.technologyreview.com/s/540136/the-next-great-gmo-debate/>.
Sammataro et al., "Some Volatile Plant Oils as Potential Control Agents for Varroa Mites (Acari: Varroidae) in Honey Bee Colonies (Hymenoptera: Apidae)," *American Bee Journal*, 138(9):681-685 (1998).
Subramoni et al., "Lipases as Pathogenicity Factors of Plant Pathogens,"*Handbook of Hydrocarbon and Lipid Microbiology*, 3269-3277 (2010).
Sun, "Characterization of Organosilicone Surfactants and Their Effects on Sulfonylurea Herbicide Activity," Thesis Submitted to the Faculty of the Virginia Polytechnic Institute and State University dated Apr. 5, 1996.
Tenllado et al., "Crude extracts of bacterially expressed dsRNA can be used to protect plants against virus infections," *BMC Biotechnology*, 3:1-11 (2003).
Tice, "Selecting the right compounds for screening: does Lipinski's Rule of 5 for pharmaceuticals apply to agrochemicals?" *Pest Management Science*, 57(1):3-16 (2001).
TransIT-TKO® Transfection Reagent, Frequently Asked Questions, Web. 2019 <https://www.mirusbio.com/tech-resources/fags/transit-tko-faqs>.
Walton, "Deconstructing the Cell Wall," *Plant Physiol.*, 104:1113-1118 11994).
Wang et al., "Principle and technology of genetic engineering in plants," in Plant genetic engineering principles and techniques, Beijing: Science Press, pp. 313-315 (1998).
Watson et al., "RNA silencing platforms in plants," *FEBS Letters*, 579:5982-5987 (2005).
Wild Carrot, Noxious Weed Control Board (NWCB) of Washington State (2010) <www.nwcb.wa.gov/detail.asp?weed=46>.
Yibrah et al.,"Antisense RNA inhibition of uidA gene expression in transgenic plants: Evidence for interaction between first and second transformation events," *Hereditas*, 118:273-280 (1993).
Zhao et al., "Vegetable Statdardized Production Technology,"*Hangzhou: Zhejiang Science and Technology Press*, p. 19 (2008).

* cited by examiner

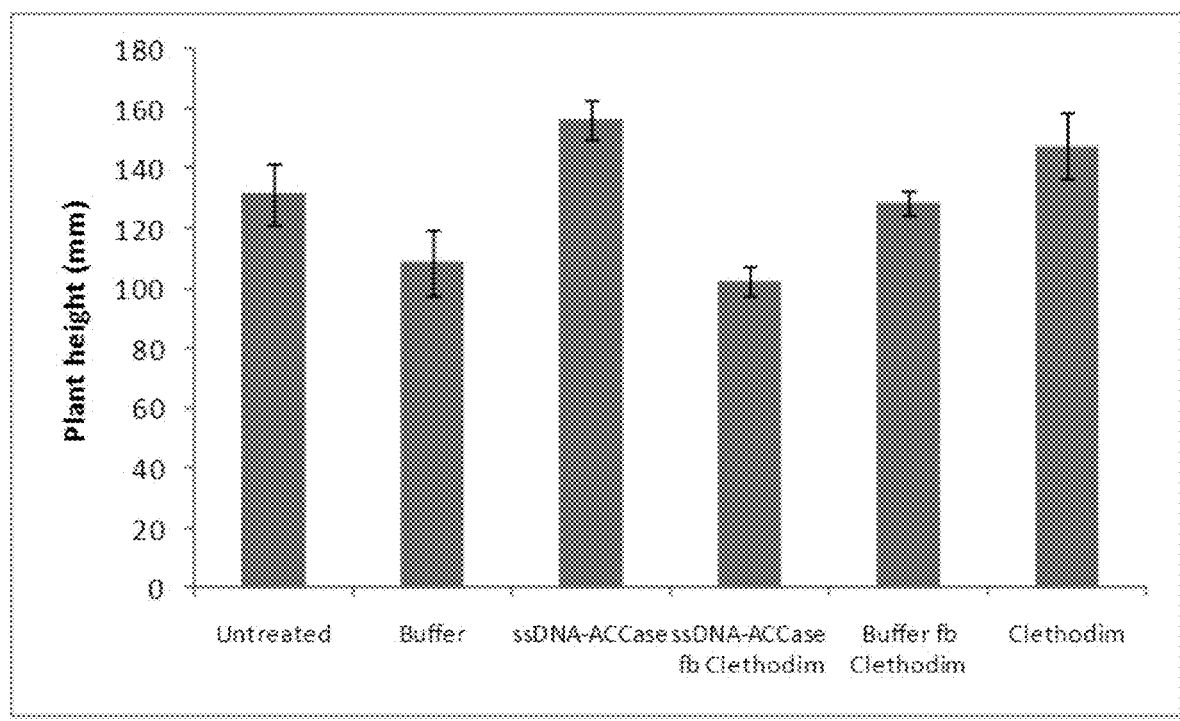

METHODS AND COMPOSITIONS FOR WEED CONTROL

CROSS-REFERENCE TO RELATED APPLICATIONS

This application is a continuation-in-part of U.S. application Ser. No. 13/612,941, filed Sep. 13, 2012, which claims the benefit of priority of U.S. Provisional Application No. 61/534,073, filed on Sep. 13, 2011, both of which are incorporated in their entirety herein by reference.

INCORPORATION OF SEQUENCE LISTING

A computer readable form of a sequence listing is filed with this application by electronic submission and is incorporated into this application by reference in its entirety. The sequence listing is contained in the file named P34112US02_SEQ.txt, which is 2,094,680 bytes in size (measured in operating system MS windows) and was created on Jul. 28, 2016.

FIELD OF THE INVENTION

The invention relates generally to the field of weed management. More specifically, the invention relates to acetyl-CoA carboxylase (ACCase) genes in weedy plants and compositions containing polynucleotide molecules for modulating their expression. The invention further provides methods and compositions useful for weed control.

BACKGROUND OF THE INVENTION

Weeds are plants that compete with cultivated plants in an agronomic environment and cost farmers billions of dollars annually in crop losses and the expense of efforts to keep weeds under control. Weeds also serve as hosts for crop diseases and insect pests. The losses caused by weeds in agricultural production environments include decreases in crop yield, reduced crop quality, increased irrigation costs, increased harvesting costs, reduced land value, injury to livestock, and crop damage from insects and diseases harbored by the weeds. The principal means by which weeds cause these effects are: 1) competing with crop plants for water, nutrients, sunlight and other essentials for growth and development, 2) production of toxic or irritant chemicals that cause human or animal health problem, 3) production of immense quantities of seed or vegetative reproductive parts or both that contaminate agricultural products and perpetuate the species in agricultural lands, and 4) production on agricultural and nonagricultural lands of vast amounts of vegetation that must be disposed of. Herbicide tolerant weeds are a problem with nearly all herbicides in use, there is a need to effectively manage these weeds. There are over 365 weed biotypes currently identified as being herbicide resistant to one or more herbicides by the Herbicide Resistance Action Committee (HRAC), the North American Herbicide Resistance Action Committee (NAHRAC), and the Weed Science Society of America (WSSA).

The Acetyl-CoA carboxylase (ACCase) enzyme catalyzes the biotin-dependent carboxylation of acetyl-CoA to produce malonyl-CoA, this is the first and the committed step in the biosynthesis of long-chain fatty acids. This enzyme is the target of many herbicides that include members of the chemical families of aryloxyphenoxypropionates, cyclohexanediones and phenylpyrazoline.

SUMMARY OF THE INVENTION

In one aspect, the invention provides a method of weedy plant control comprising an external application to a weedy plant of a composition comprising a polynucleotide and a transfer agent, wherein the polynucleotide is essentially identical or essentially complementary to an ACCase gene sequence or fragment thereof, or to the RNA transcript of said ACCase gene sequence or fragment thereof, wherein said ACCase gene sequence is selected from the group consisting of SEQ ID NOs: 1-92 or a polynucleotide fragment thereof, whereby the weedy plant growth or development or reproductive ability is reduced or the weedy plant is more sensitive to an ACCase inhibitor herbicide relative to a weedy plant not treated with said composition. In this manner, plants that have become resistant to the application of an ACCase inhibitor containing herbicides may be made more susceptible to the herbicidal effects of an ACCase inhibitor containing herbicide, thus potentiating the effect of the herbicide. The polynucleotide fragment is at least 18 contiguous nucleotides, at least 19 contiguous nucleotides, at least 20 contiguous nucleotides or at least 21 contiguous nucleotides in length and at least 85 percent identical to an ACCase gene sequence selected from the group consisting of SEQ ID NOs: 1-92 and the transfer agent is an organosilicone composition or compound. The polynucleotide fragment can also be sense or anti-sense ssDNA or ssRNA, dsRNA, or dsDNA, or dsDNA/RNA hybrids. The composition can include more than one polynucleotide fragments, and the composition can include an ACCase inhibitor herbicide and/or other herbicides that enhance the weed control activity of the composition.

In another aspect of the invention, polynucleotide molecules and methods for modulating ACCase gene expression in weedy plant species are provided. The method reduces, represses or otherwise delays expression of an ACCase gene in a weedy plant comprising an external application to a weedy plant of a composition comprising a polynucleotide and a transfer agent, wherein the polynucleotide is essentially identical or essentially complementary to an ACCase gene sequence, represses or otherwise delays, or to the RNA transcript of the ACCase gene sequence, represses or otherwise delays, wherein the ACCase gene sequence is selected from the group consisting of SEQ ID NOs: 1-92 or a polynucleotide fragment thereof. The polynucleotide fragment is at least 18 contiguous nucleotides, at least 19 contiguous nucleotides, at least 20 contiguous nucleotides at least 21 contiguous nucleotides in length and at least 85 percent identical to an ACCase gene sequence selected from the group consisting of SEQ ID NOs: 1-92 and the transfer agent is an organosilicone compound. The polynucleotide fragment can also be sense or anti-sense ssDNA or ssRNA, dsRNA, or dsDNA, or dsDNA/RNA hybrids.

In a further aspect of the invention, the polynucleotide molecule containing composition of the invention may be combined with other herbicidal compounds to provide additional control of unwanted plants in a field of cultivated plants.

In a further aspect, the polynucleotide molecule composition may be combined with any one or more additional agricultural chemicals, such as, insecticides, fungicides, nematocides, bactericides, acaricides, growth regulators, chemosterilants, semiochemicals, repellents, attractants, pheromones, feeding stimulants, biopesticides, microbial pesticides or other biologically active compounds to form a multi-component pesticide giving an even broader spectrum of agricultural protection.

BRIEF DESCRIPTION OF THE FIGURE

The following drawings form part of the present specification and are included to further demonstrate certain aspects of the present invention. The invention may be better understood by reference to one or more of these drawings in combination with the detailed description of specific embodiments presented herein. The invention can be more fully understood from the following description of the FIGURE:

FIG. 1. Treatment of *Amaranthus* palmer with ssDNA trigger polynucleotides and ACCase inhibitor herbicide, clethodim.

DETAILED DESCRIPTION

Provides are methods and compositions containing a polynucleotide that provide for regulation, repression or delay of ACCase (Acetyl-CoA carboxylase) gene expression and enhanced control of weedy plant species and importantly ACCase inhibitor resistant weed biotypes. Aspects of the method can be applied to manage various weedy plants in agronomic and other cultivated environments.

The following definitions and methods are provided to better define the present invention and to guide those of ordinary skill in the art in the practice of the present invention. Unless otherwise noted, terms are to be understood according to conventional usage by those of ordinary skill in the relevant art. Where a term is provided in the singular, the inventors also contemplate aspects of the invention described by the plural of that term.

By "non-transcribable" polynucleotides is meant that the polynucleotides do not comprise a complete polymerase II transcription unit. As used herein "solution" refers to homogeneous mixtures and non-homogeneous mixtures such as suspensions, colloids, micelles, and emulsions.

Weedy plants are plants that compete with cultivated plants, those of particular importance include, but are not limited to important invasive and noxious weeds and herbicide resistant biotypes in crop production, such as, *Amaranthus* species—*A. albus*, *A. blitoides*, *A. hybridus*, *A. palmeri*, *A. powellii*, *A. retroflexus*, *A. spinosus*, *A. tuberculatus*, and *A. viridis*; *Ambrosia* species—*A. trifida*, *A. artemisifolia*; *Lolium* species—*L. multiflorum*, *L. rigidum*, *L perenne*; *Digitaria* species—*D. insularis*; *Euphorbia* species—*E. heterophylla*; *Kochia* species—*K. scoparia*; *Sorghum* species—*S. halepense*; *Conyza* species—*C. bonariensis*, *C. canadensis*, *C. sumatrensis*; *Chloris* species—*C. truncate*; *Echinochola* species—*E. colona*, *E. crus-galli*; *Eleusine* species—*E. indica*; *Poa* species—*P. annua*; *Plantago* species—*P. lanceolata*; *Avena* species—*A. fatua*; *Chenopodium* species—*C. album*; *Setaria* species—*S. viridis*, *Abutilon theophrasti*, *Ipomoea* species, *Sesbania*, species, *Cassia* species, *Sida* species, *Brachiaria*, species, and *Solanum* species.

Additional weedy plant species found in cultivated areas include *Alopecurus myosuroides*, *Avena sterilis*, *Avena sterilis ludoviciana*, *Brachiaria plantaginea*, *Bromus diandrus*, *Bromus rigidus*, *Cynosurus echinatus*, *Digitaria ciliaris*, *Digitaria ischaemum*, *Digitaria sanguinalis*, *Echinochloa oryzicola*, *Echinochloa phyllopogon*, *Eriochloa punctata*, *Hordeum glaucum*, *Hordeum leporinum*, *Ischaemum rugosum*, *Leptochloa chinensis*, *Lolium persicum*, *Phalaris minor*, *Phalaris paradoxa*, *Rottboellia exalta*, *Setaria faberi*, *Setaria viridis* var. *robusta-alba schreiber*, *Setaria viridis* var. *robusta-purpurea*, *Snowdenia polystachea*, *Sorghum sudanese*, *Alisma plantago-aquatica*, *Amaranthus lividus*, *Amaranthus quitensis*, *Ammania auriculata*, *Ammania coccinea*, *Anthemis cotula*, *Apera spica-venti*, *Bacopa rotundifolia*, *Bidens pilosa*, *Bidens subalternans*, *Brassica tournefortii*, *Bromus tectorum*, *Camelina microcarpa*, *Chrysanthemum coronarium*, *Cuscuta campestris*, *Cyperus difformis*, *Damasonium minus*, *Descurainia sophia*, *Diplotaxis tenuifolia*, *Echium plantagineum*, *Elatine triandra* var. *pedicellata*, *Euphorbia heterophylla*, *Fallopia convolvulus*, *Fimbristylis miliacea*, *Galeopsis tetrahit*, *Galium spurium*, *Helianthus annuus*, *Iva xanthifolia*, *Ixophorus unisetus*, *Ipomoea indica*, *Ipomoea purpurea*, *Ipomoea sepiaria*, *Ipomoea aquatic*, *Ipomoea triloba*, *Lactuca serriola*, *Limnocharis flava*, *Limnophila erecta*, *Limnophila sessiliflora*, *Lindernia dubia*, *Lindernia dubia* var. *major*, *Lindernia micrantha*, *Lindernia procumbens*, *Mesembryanthemum crystallinum*, *Monochoria korsakowii*, *Monochoria vaginalis*, *Neslia paniculata*, *Papaver rhoeas*, *Parthenium hysterophorus*, *Pentzia suffruticosa*, *Phalaris minor*, *Raphanus raphanistrum*, *Raphanus sativus*, *Rapistrum rugosum*, *Rotala indica* var. *uliginosa*, *Sagittaria guyanensis*, *Sagittaria montevidensis*, *Sagittaria pygmaea*, *Salsola iberica*, *Scirpus juncoides* var. *ohwianus*, *Scirpus mucronatus*, *Setaria lutescens*, *Sida spinosa*, *Sinapis arvensis*, *Sisymbrium orientale*, *Sisymbrium thellungii*, *Solanum ptycanthum*, *Sonchus aspen*, *Sonchus oleraceus*, *Sorghum bicolor*, *Stellaria media*, *Thlaspi arvense*, *Xanthium strumarium*, *Arctotheca calendula*, *Conyza sumatrensis*, *Crassocephalum crepidiodes*, *Cuphea carthagenenis*, *Epilobium adenocaulon*, *Erigeron philadelphicus*, *Landoltia punctata*, *Lepidium virginicum*, *Monochoria korsakowii*, *Solanum americanum*, *Solanum nigrum*, *Vulpia bromoides*, *Youngia japonica*, *Hydrilla verticillata*, *Carduus nutans*, *Carduus pycnocephalus*, *Centaurea solstitialis*, *Cirsium arvense*, *Commelina diffusa*, *Convolvulus arvensis*, *Daucus carota*, *Digitaria ischaemum*, *Echinochloa crus-pavonis*, *Fimbristylis miliacea*, *Galeopsis tetrahit*, *Galium spurium*, *Limnophila erecta*, *Matricaria perforate*, *Papaver rhoeas*, *Ranunculus acris*, *Soliva sessilis*, *Sphenoclea zeylanica*, *Stellaria media*, *Nassella trichotoma*, *Stipa neesiana*, *Agrostis stolonifera*, *Polygonum aviculare*, *Alopecurus japonicus*, *Beckmannia syzigachne*, *Bromus tectorum*, *Chloris inflate*, *Echinochloa erecta*, *Portulaca oleracea*, and *Senecio vulgaris*. It is believed that all plants contain a phytoene desaturase gene in their genome, the sequence of which can be isolated and polynucleotides made according to the methods of the present invention that are useful for regulation, suppressing or delaying the expression of the target ACCase gene in the plants and the growth or development of the treated plants.

Some cultivated plants may also be weedy plants when they occur in unwanted environments. For example, corn plants growing in a soybean field. Transgenic crops with one or more herbicide tolerances will need specialized methods of management to control weeds and volunteer crop plants. The present invention enables the targeting of a transgene for herbicide tolerance to permit the treated plants to become sensitive to the herbicide. For example, transgene ACCase DNA sequences in transgenic events that include DAS-40278-9.

A "trigger" or "trigger polynucleotide" is a polynucleotide molecule that is homologous or complementary to a target gene polynucleotide. The trigger polynucleotide molecules modulate expression of the target gene when topically applied to a plant surface with a transfer agent, whereby a plant treated with said composition has its growth or development or reproductive ability regulated, suppressed or delayed or said plant is more sensitive to an ACCase inhibitor herbicide as a result of said polynucleotide containing composition relative to a plant not treated with a composition containing the trigger molecule.

It is contemplated that the composition of the present invention will contain multiple polynucleotides and herbicides that include but not limited to ACCase gene trigger polynucleotides and an ACCase inhibitor herbicide and anyone or more additional herbicide target gene trigger polynucleotides and the related herbicides and anyone or more additional essential gene trigger polynucleotides. Essential genes are genes in a plant that provide key enzymes or other proteins, for example, a biosynthetic enzyme, metabolizing enzyme, receptor, signal transduction protein, structural gene product, transcription factor, or transport protein; or regulating RNAs, such as, microRNAs, that are essential to the growth or survival of the organism or cell or involved in the normal growth and development of the plant (Meinke, et al., *Trends Plant Sci.* 2008 September; 13(9):483-91). The suppression of an essential gene enhances the effect of a herbicide that affects the function of a gene product different than the suppressed essential gene. The compositions of the present invention can include various trigger polynucleotides that modulate the expression of an essential gene other than ACCase.

Herbicides for which transgenes for plant tolerance have been demonstrated and the method of the present invention can be applied, include but are not limited to: auxin-like herbicides, glyphosate, glufosinate, sulfonylureas, imidazolinones, bromoxynil, delapon, dicamba, cyclohezanedione, protoporphyrionogen oxidase inhibitors, 4-hydroxyphenyl-pyruvate-dioxygenase inhibitors herbicides. For example, transgenes and their polynucleotide molecules that encode proteins involved in herbicide tolerance are known in the art, and include, but are not limited to an 5-enolpyruvylshikimate-3-phosphate synthase (EPSPS), for example, as more fully described in U.S. Pat. No. 7,807,791 (SEQ ID NO:5); U.S. Pat. Nos. 6,248,876 B1; 5,627,061; 5,804,425; 5,633,435; 5,145,783; 4,971,908; 5,3072,910; 5,188,642; 4,940,835; 5,866,775; 6,225,114 B1; 6,130,366; 5,3070, 667; 4,535,060; 4,769,061; 5,633,448; 5,510,471; U.S. Pat. No. Re. 36,449; U.S. Pat. Nos. RE 37,287 E; and 5,491,288; tolerance to sulfonylurea and/or imidazolinone, for example, as described more fully in U.S. Pat. Nos. 5,605,011; 5,013, 659; 5,141,870; 5,767,361; 5,7307,180; 5,304,732; 4,761, 373; 5,3307,107; 5,928,937; and 5,378,824; and international publication WO 96/33270; tolerance to hydroxyphenylpyruvatedioxygenases inhibiting herbicides in plants are described in U.S. Pat. Nos. 6,245,968 B1; 6,268,549; and 6,069,115; US Pat. Pub. 20110191897 and U.S. Pat. No. 7,3072,379 SEQ ID NO:3; U.S. Pat. Nos. 7,935,869; 7,304,209, SEQ ID NOs:1, 3, 5 and 15; aryloxyalkanoate dioxygenase polynucleotides, which confer tolerance to 2,4-D and other phenoxy auxin herbicides as well as to aryloxyphenoxypropionate herbicides as described, for example, in WO2005/107437; U.S. Pat. No. 7,838,733 SEQ ID NO:5) and dicamba-tolerance polynucleotides as described, for example, in Herman et al. (2005) *J. Biol. Chem.* 280: 24759-24767. Other examples of herbicide-tolerance traits include those conferred by polynucleotides encoding an exogenous phosphinothricin acetyltransferase, as described in U.S. Pat. Nos. 5,969,213; 5,489,520; 5,550, 3078; 5,874,265; 5,919,675; 5,561,236; 5,648,477; 5,646, 024; 6,177,616; and 5,879,903. Plants containing an exogenous phosphinothricin acetyltransferase can exhibit improved tolerance to glufosinate herbicides, which inhibit the enzyme glutamine synthase. Additionally, herbicide-tolerance polynucleotides include those conferred by polynucleotides conferring altered protoporphyrinogen oxidase (protox) activity, as described in U.S. Pat. Nos. 6,288,306 B1; 6,282,837 B1; and 5,767,373; and WO 01/12825. Plants containing such polynucleotides can exhibit improved tolerance to any of a variety of herbicides which target the protox enzyme (also referred to as protox inhibitors). Polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al, (1993) *Plant J.* 4:833-840 and Misawa et al, (1994) *Plant* 6:481-489 for norflurazon tolerance; a polynucleotide molecule encoding acetohydroxyacid synthase (AHAS, aka ALS) described in Sathasiivan et al. (1990) *Nucl. Acids Res.* 18:3078-2193 for tolerance to sulfonylurea herbicides; and the bar gene described in DeBlock, et al. (1987) *EMBO J.* 6:2513-2519 for glufosinate and bialaphos tolerance. The transgenic coding regions and regulatory elements of the herbicide tolerance genes are targets in which polynucleotide triggers and herbicides can be included in the composition of the present invention.

The composition of the present invention include a component that is an ACCase inhibitor herbicide, which include members of the chemical families of aryloxyphenoxypropionates, cyclohexanediones and phenylpyrazoline that include, but are not limited to an aryloxyphenoxypropionate comprising clodinafop (Propanoic acid, 2-[4-[(5-chloro-3-fluoro-2-pyridinyl)oxy]phenoxy]-, 2-propynyl ester, (2R)), cyhalofop (butyl(2R)-2-[4-(4-cyano-2-fluorophenoxy)phenoxy] propionate), diclofop (methyl 2-[4-(2,4-dichlorophenoxy)phenoxy]propanoate), fenoxaprop (ethyl (R)-2-[4-(6-chloro-1,3-benzoxazol-2-yloxy)phenoxy]propionate), fluazifop (2R)-2-[4-[[5-(trifluoromethyl)-2-pyridinyl]oxy] phenoxy]propanoic acid), haloxyfop (2-[4-[[3-chloro-5-(trifluoromethyl)-2-pyridinyl]oxy]phenoxy]propanoic acid), propaquizafop (2-[[(1-methylethylidene)amino]oxy]ethyl (2R)-2-[4-[(6-chloro-2quinoxalinyl)oxy]phenoxy]propanoate) and quizalofop(2R)-2-[4-[(6-chloro-2-quinoxalinyl) oxy]phenoxy]propanoic acid; a cyclohexanedione comprising alloxydim (methyl 2,2-dimethyl-4,6-dioxo-5-[(1E)-1-[(2-propen-1-yloxy)imino]butyl]cyclohexanecarboxylate), butroxydim (2-[1-(ethoxyimino)propyl]-3-hydroxy-5-[2,4, 6-trimethyl-3-(1-oxobutyl)phenyl]-2-cyclohexen-1-one), clethodim (2-[1-[[[(2E)-3-chloro-2-propen-1-yl]oxy]imino] propyl]-5-[2-(ethylthio)propyl]-3-hydroxy-2-cyclohexen-1-one), cycloxydim (2-[1-(ethoxyimino)butyl]-3-hydroxy-5-(tetrahydro-2H-thiopyran-3-yl)-2-cyclohexen-1-one), profoxydim (2-[1-[[2-(4-chlorophenoxy)propoxy]imino]butyl]-3-hydroxy-5-(tetrahydro-2H-thiopyran-3-yl)-2-cyclohexen-1-one), sethoxydim (2-[1-(ethoxyimino)butyl]-5-[2-(ethylthio)propyl]-3-hydroxy-2-cyclohexen-1-one), tepraloxydim (2-[1-[[[(2E)-3-chloro-2-propen-1-yl]oxy] imino]propyl]-3-hydroxy-5-(tetrahydro-2H-pyran-4-yl)-2-cyclohexen-1-one) and tralkoxydim (2-[1-(ethoxyimino) propyl]-3-hydroxy-5-(2,4,6-trimethylphenyl)-2-cyclohexen-1-one); a phenylpyrazoline comprising pinoxaden (8-(2,6-diethyl-4-methylphenyl)-1,2,4,5-tetrahydro-7-oxo-7H-pyrazolo[1,2-d][1,4,5]oxadiazepin-9-yl 2,2-dimethylpropanoate).

Numerous herbicides with similar or different modes of action (herein referred to as co-herbicides) are available that can be added to the composition of the present invention, for example, members of the herbicide families that include but are not limited to amide herbicides, aromatic acid herbicides, arsenical herbicides, benzothiazole herbicides, benzoylcyclohexanedione herbicides, benzofuranyl alkylsulfonate herbicides, carbamate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides. In particular, the rates of use of the added herbicides can be reduced in compositions comprising the polynucleotides of the invention. Use rate reductions of the additional added herbicides can be 10-25 percent, 26-50 percent, 51-75 percent or more can be achieved that enhance the activity of the polynucleotides and herbicide composition and is contemplated as an aspect of the invention. Representative co-herbicides of the families include but are not limited to acetochlor, acifluorfen, acifluorfen-sodium, aclonifen, acrolein, alachlor, alloxydim, allyl alcohol, ametryn, amicarbazone, amidosulfuron, aminopyralid, amitrole, ammonium sulfamate, anilofos, asulam, atraton, atrazine, azimsulfuron, BCPC, beflubutamid, benazolin, benfluralin, benfuresate, bensulfuron, bensulfuron-methyl, bensulide, bentazone, benzfendizone, benzobicyclon, benzofenap, bifenox, bilanafos, bispyribac, bispyribac-sodium, borax, bromacil, bromobutide, bromoxynil, butachlor, butafenacil, butamifos, butralin, butroxydim, butylate, cacodylic acid, calcium chlorate, cafenstrole, carbetamide, carfentrazone, carfentrazone-ethyl, CDEA, CEPC, chlorflurenol, chlorflurenol-methyl, chloridazon, chlorimuron, chlorimuron-ethyl, chloroacetic acid, chlorotoluron, chlorpropham, chlorsulfuron, chlorthal, chlorthal-dimethyl, cinidon-ethyl, cinmethylin, cinosulfuron, cisanilide, clethodim, clodinafop, clodinafop-propargyl, clomazone, clomeprop, clopyralid, cloransulam, cloransulam-methyl, CMA, 4-CPB, CPMF, 4-CPP, CPPC, cresol, cumyluron, cyanamide, cyanazine, cycloate, cyclosulfamuron, cycloxydim, cyhalofop, cyhalofop-butyl, 2,4-D, 3,4-DA, daimuron, dalapon, dazomet, 2,4-DB, 3,4-DB, 2,4-DEB, desmedipham, dicamba, dichlobenil, ortho-dichlorobenzene, para-dichlorobenzene, dichlorprop, dichlorprop-P, diclofop, diclofop-methyl, diclosulam, difenzoquat, difenzoquat metilsulfate, diflufenican, diflufenzopyr, dimefuron, dimepiperate, dimethachlor, dimethametryn, dimethenamid, dimethenamid-P, dimethipin, dimethylarsinic acid, dinitramine, dinoterb, diphenamid, diquat, diquat dibromide, dithiopyr, diuron, DNOC, 3,4-DP, DSMA, EBEP, endothal, EPTC, esprocarb, ethalfluralin, ethametsulfuron, ethametsulfuron-methyl, ethofumesate, ethoxyfen, ethoxysulfuron, etobenzanid, fenoxaprop-P, fenoxaprop-P-ethyl, fentrazamide, ferrous sulfate, flamprop-M, flazasulfuron, florasulam, fluazifop, fluazifop-butyl, fluazifop-P, fluazifop-P-butyl, flucarbazone, flucarbazone-sodium, flucetosulfuron, fluchloralin, flufenacet, flufenpyr, flufenpyr-ethyl, flumetsulam, flumiclorac, flumiclorac-pentyl, flumioxazin, fluometuron, fluoroglycofen, fluoroglycofen-ethyl, flupropanate, flupyrsulfuron, flupyrsulfuron-methyl-sodium, flurenol, fluridone, fluorochloridone, fluoroxypyr, flurtamone, fluthiacet, fluthiacet-methyl, fomesafen, foramsulfuron, fosamine, glufosinate, glufosinate-ammonium, glyphosate, halosulfuron, halosulfuron-methyl, haloxyfop, haloxyfop-P, HC-252, hexazinone, imazamethabenz, imazamethabenz-methyl, imazamox, imazapic, imazapyr, imazaquin, imazethapyr, imazosulfuron, indanofan, iodomethane, iodosulfuron, iodosulfuron-methyl-sodium, ioxynil, isoproturon, isouron, isoxaben, isoxachlortole, isoxaflutole, karbutilate, lactofen, lenacil, linuron, MAA, MAMA, MCPA, MCPA-thioethyl, MCPB, mecoprop, mecoprop-P, mefenacet, mefluidide, mesosulfuron, mesosulfuron-methyl, mesotrione, metam, metamifop, metamitron, metazachlor, methabenzthiazuron, methylarsonic acid, methyldymron, methyl isothiocyanate, metobenzuron, metolachlor, S-metolachlor, metosulam, metoxuron, metribuzin, metsulfuron, metsulfuron-methyl, MK-66, molinate, monolinuron, MSMA, naproanilide, napropamide, naptalam, neburon, nicosulfuron, nonanoic acid, norflurazon, oleic acid (fatty acids), orbencarb, orthosulfamuron, oryzalin, oxadiargyl, oxadiazon, oxasulfuron, oxaziclomefone, oxyfluorfen, paraquat, paraquat dichloride, pebulate, pendimethalin, penoxsulam, pentachlorophenol, pentanochlor, pentoxazone, pethoxamid, petrolium oils, phenmedipham, phenmedipham-ethyl, picloram, picolinafen, pinoxaden, piperophos, potassium arsenite, potassium azide, pretilachlor, primisulfuron, primisulfuron-methyl, prodiamine, profluazol, profoxydim, prometon, prometryn, propachlor, propanil, propaquizafop, propazine, propham, propisochlor, propoxycarbazone, propoxycarbazone-sodium, propyzamide, prosulfocarb, prosulfuron, pyraclonil, pyraflufen, pyraflufen-ethyl, pyrazolynate, pyrazosulfuron, pyrazosulfuron-ethyl, pyrazoxyfen, pyribenzoxim, pyributicarb, pyridafol, pyridate, pyriftalid, pyriminobac, pyriminobac-methyl, pyrimisulfan, pyrithiobac, pyrithiobac-sodium, quinclorac, quinmerac, quinoclamine, quizalofop, quizalofop-P, rimsulfuron, sethoxydim, siduron, simazine, simetryn, SMA, sodium arsenite, sodium azide, sodium chlorate, sulcotrione, sulfentrazone, sulfometuron, sulfometuron-methyl, sulfosate, sulfosulfuron, sulfuric acid, tar oils, 2,3,6-TBA, TCA, TCA-sodium, tebuthiuron, tepraloxydim, terbacil, terbumeton, terbuthylazine, terbutryn, thenylchlor, thiazopyr, thifensulfuron, thifensulfuron-methyl, thiobencarb, tiocarbazil, topramezone, tralkoxydim, tri-allate, triasulfuron, triaziflam, tribenuron, tribenuron-methyl, tricamba, triclopyr, trietazine, trifloxysulfuron, trifloxysulfuron-sodium, trifluralin, triflusulfuron, triflusulfuron-methyl, trihydroxytriazine, tritosulfuron, [3-[2-chloro-4-fluoro-5-(-methyl-6-trifluoromethyl-2,4-dioxo-, 2,3,4-tetrahydropyrimidin-3-yl)phenoxy]-2-pyridyloxy]acetic acid ethyl ester (CAS RN 353292-3-6), 4-[(4,5-dihydro-3-methoxy-4-methyl-5-oxo)-H—, 2,4-triazol-1-ylcarbonylsulfamoyl]-5-methylthiophene-3-carboxylic acid (BAY636), BAY747 (CAS RN 33504-84-2), topramezone (CAS RN 2063-68-8), 4-hydroxy-3-[[2-[(2-methoxyethoxy)methyl]-6-(trifluoro-methyl)-3-pyridi-nyl]carbonyl]-bicyclo [3.2.]oct-3-en-2-one (CAS RN 35200-68-5), and 4-hydroxy-3-[[2-(3-methoxypropyl)-6-(difluoromethyl)-3-pyridinyl]carbon-yl]-bicyclo[3.2.]oct-3-en-2-one. Additionally, including herbicidal compounds of unspecified modes of action as described in CN101279950A, CN101279951A, DE10000600A1, DE10116399A1, DE102004054666A1, DE102005014638A1, DE102005014906A1, DE102007012168A1, DE102010042866A1, DE10204951A1, DE10234875A1, DE10234876A1, DE10256353A1, DE10256354A1, DE10256367A1, EP1157991A2, EP1238586A1, EP2147919A1, EP2160098A2, JP03968012B2, JP2001253874A,

| | | |
|---|---|---|
| JP2002080454A, | JP2002138075A, | JP2002145707A, |
| JP2002220389A, | JP2003064059A, | JP2003096059A, |
| JP2004051628A, | JP2004107228A, | JP2005008583A, |
| JP2005239675A, | JP2005314407A, | JP2006232824A, |
| JP2006282552A, | JP2007153847A, | JP2007161701A, |
| JP2007182404A, | JP2008074840A, | JP2008074841A, |
| JP2008133207A, | JP2008133218A, | JP2008169121A, |
| JP2009067739A, | JP2009114128A, | JP2009126792A, |
| JP2009137851A, | US20060111241A1, | US20090036311A1, |
| US20090054240A1, | | US20090215628A1, |
| US20100099561A1, | | US20100152443A1, |
| US20110105329A1, | | US20110201501A1, |
| WO2001055066A2, | | WO2001056975A1, |
| WO2001056979A1, | | WO2001090071A2, |
| WO2001090080A1, | | WO2002002540A1, |
| WO2002028182A1, | | WO2002040473A1, |
| WO2002044173A2, | | WO2003000679A2, |
| WO2003006422A1, | | WO2003013247A1, |
| WO2003016308A1, | | WO2003020704A1, |
| WO2003022051A1, | | WO2003022831A1, |
| WO2003022843A1, | | WO2003029243A2, |
| WO2003037085A1, | | WO2003037878A1, |
| WO2003045878A2, | | WO2003050087A2, |
| WO2003051823A1, | | WO2003051824A1, |
| WO2003051846A2, | | WO2003076409A1, |
| WO2003087067A1, | | WO2003090539A1, |
| WO2003091217A1, | | WO2003093269A2, |
| WO2003104206A2, | | WO2004002947A1, |
| WO2004002981A2, | | WO2004011429A1, |
| WO2004029060A1, | | WO2004035545A2, |
| WO2004035563A1, | | WO2004035564A1, |
| WO2004037787A1, | | WO2004067518A1, |
| WO2004067527A1, | | WO2004077950A1, |
| WO2005000824A1, | | WO2005007627A1, |
| WO2005040152A1, | | WO2005047233A1, |
| WO2005047281A1, | | WO2005061443A2, |
| WO2005061464A1, | | WO2005068434A1, |
| WO2005070889A1, | | WO2005089551A1, |
| WO2005095335A1, | | WO2006006569A1, |
| WO2006024820A1, | | WO2006029828A1, |
| WO2006029829A1, | | WO2006037945A1, |
| WO2006050803A1, | | WO2006090792A1, |
| WO2006123088A2, | | WO2006125687A1, |
| WO2006125688A1, | | WO2007003294A1, |
| WO2007026834A1, | | WO2007071900A1, |
| WO2007077201A1, | | WO2007077247A1, |
| WO2007096576A1, | | WO2007119434A1, |
| WO2007134984A1, | | WO2008009908A1, |
| WO2008029084A1, | | WO2008059948A1, |
| WO2008071918A1, | | WO2008074991A1, |
| WO2008084073A1, | | WO2008100426A2, |
| WO2008102908A1, | | WO2008152072A2, |
| WO2008152073A2, | | WO2009000757A1, |
| WO2009005297A2, | | WO2009035150A2, |
| WO2009063180A1, | | WO2009068170A2, |
| WO2009068171A2, | | WO2009086041A1, |
| WO2009090401A2, | | WO2009090402A2, |
| WO2009115788A1, | | WO2009116558A1, |
| WO2009152995A1, | | WO2009158258A1, |
| WO2010012649A1, | | WO2010012649A1, |
| WO2010026989A1, | | WO2010034153A1, |
| WO2010049270A1, | | WO2010049369A1, |
| WO2010049405A1, | | WO2010049414A1, |
| WO2010063422A1, | | WO2010069802A1, |
| WO2010078906A2, | | WO2010078912A1, |
| WO2010104217A1, | | WO2010108611A1, |
| WO2010112826A3, | | WO2010116122A3, |
| WO2010119906A1, | | WO2010130970A1, |
| WO2011003776A2, | | WO2011035874A1, |
| WO2011065451A1, all of which are incorporated herein by reference. | | |

An agronomic field in need of plant control is treated by application of the composition of the present invention directly to the surface of the growing plants, such as by a spray. For example, the method is applied to control weeds in a field of crop plants by spraying the field with the composition. The composition can be provided as a tank mix, a sequential treatment of components (generally the polynucleotide containing composition followed by the herbicide), or a simultaneous treatment or mixing of one or more of the components of the composition from separate containers. Treatment of the field can occur as often as needed to provide weed control and the components of the composition can be adjusted to target specific weed species or weed families through utilization of specific polynucleotides or polynucleotide compositions capable of selectively targeting the specific species or plant family to be controlled. The composition can be applied at effective use rates according to the time of application to the field, for example, preplant, at planting, post planting, post harvest. ACCase inhibitor herbicides can be applied to a field at rates of 10 to 500 g ai/ha (active ingredient per hectare) or more. The polynucleotides of the composition can be applied at rates of 1 to 30 grams per acre depending on the number of trigger molecules needed for the scope of weeds in the field.

Crop plants in which weed control is needed include but are not limited to, i) corn, soybean, cotton, canola, sugar beet, alfalfa, sugarcane, rice, and wheat; ii) vegetable plants including, but not limited to, tomato, sweet pepper, hot pepper, melon, watermelon, cucumber, eggplant, cauliflower, broccoli, lettuce, spinach, onion, peas, carrots, sweet corn, Chinese cabbage, leek, fennel, pumpkin, squash or gourd, radish, Brussels sprouts, tomatillo, garden beans, dry beans, or okra; iii) culinary plants including, but not limited to, basil, parsley, coffee, or tea; or, iv) fruit plants including but not limited to apple, pear, cherry, peach, plum, apricot, banana, plantain, table grape, wine grape, citrus, avocado, mango, or berry; v) a tree grown for ornamental or commercial use, including, but not limited to, a fruit or nut tree; or, vi) an ornamental plant (e.g., an ornamental flowering plant or shrub or turf grass). The methods and compositions provided herein can also be applied to plants produced by a cutting, cloning, or grafting process (i.e., a plant not grown from a seed) include fruit trees and plants that include, but are not limited to, citrus, apples, avocados, tomatoes, eggplant, cucumber, melons, watermelons, and grapes as well as various ornamental plants.

Pesticidal Mixtures

The polynucleotide compositions may also be used as mixtures with various agricultural chemicals and/or insecticides, miticides and fungicides, pesticidal and biopesticidal agents. Examples include but are not limited to azinphosmethyl, acephate, isoxathion, isofenphos, ethion, etrimfos, oxydemeton-methyl, oxydeprofos, quinalphos, chlorpyrifos, chlorpyrifos-methyl, chlorfenvinphos, cyanophos, dioxabenzofos, dichlorvos, disulfoton, dimethylvinphos, dimethoate, sulprofos, diazinon, thiometon, tetrachlorvinphos, temephos, tebupirimfos, terbufos, naled, vamidothion, pyraclofos, pyridafenthion, pirimiphos-methyl, fenitrothion, fenthion, phenthoate, flupyrazophos, prothiofos, propaphos, profenofos, phoxime, phosalone, phosmet, formothion, phorate, malathion, mecarbam, mesulfenfos, methamidophos, methidathion, parathion, methyl parathion, monocrotophos, trichlorphon, EPN, isazophos, isamidofos, cadusafos, diamidaphos, dichlofenthion, thionazin, fenamiphos, fosthiazate, fosthietan, phosphocarb, DSP, ethoprophos, alanycarb, aldicarb, isoprocarb, ethiofencarb, carbaryl, carbosulfan, xylylcarb, thiodicarb, pirimicarb, fenobucarb, furathiocarb, propoxur, bendiocarb, benfuracarb, methomyl, metolcarb, XMC, carbofuran, aldoxycarb, oxamyl, acrinathrin, allethrin, esfenvalerate, empenthrin, cycloprothrin, cyhalothrin, gamma-cyhalothrin, lambda-cyhalothrin, cyfluthrin, beta-cyfluthrin, cypermethrin, alpha-cypermethrin, zeta-cypermethrin, silafluofen, tetramethrin, tefluthrin, deltamethrin, tralomethrin, bifenthrin, phenothrin, fenvalerate, fenpropathrin, furamethrin, prallethrin, flucythrinate, fluvalinate, flubrocythrinate, permethrin, resmethrin, ethofenprox, cartap, thiocyclam, bensultap, acetamiprid, imidacloprid, clothianidin, dinotefuran, thiacloprid, thiamethoxam, nitenpyram, chlorfluazuron, diflubenzuron, teflubenzuron, triflumuron, novaluron, noviflumuron, bistrifluoron, fluazuron, flucycloxuron, flufenoxuron, hexaflumuron, lufenuron, chromafenozide, tebufenozide, halofenozide, methoxyfenozide, diofenolan, cyromazine, pyriproxyfen, buprofezin, methoprene, hydroprene, kinoprene, triazamate, endosulfan, chlorfenson, chlorobenzilate, dicofol, bromopropylate, acetoprole, fipronil, ethiprole, pyrethrin, rotenone, nicotine sulphate, BT (*Bacillus Thuringiensis*) agent, spinosad, abamectin, acequinocyl, amidoflumet, amitraz, etoxazole, chinomethionat, clofentezine, fenbutatin oxide, dienochlor, cyhexatin, spirodiclofen, spiromesifen, tetradifon, tebufenpyrad, binapacryl, bifenazate, pyridaben, pyrimidifen, fenazaquin, fenothiocarb, fenpyroximate, fluacrypyrim, fluazinam, flufenzin, hexythiazox, propargite, benzomate, polynactin complex, milbemectin, lufenuron, mecarbam, methiocarb, mevinphos, halfenprox, azadirachtin, diafenthiuron, indoxacarb, emamectin benzoate, potassium oleate, sodium oleate, chlorfenapyr, tolfenpyrad, pymetrozine, fenoxycarb, hydramethylnon, hydroxy propyl starch, pyridalyl, flufenerim, flubendiamide, flonicamid, metaflumizole, lepimectin, TPIC, albendazole, oxibendazole, oxfendazole, trichlamide, fensulfothion, fenbendazole, levamisole hydrochloride, morantel tartrate, dazomet, metam-sodium, triadimefon, hexaconazole, propiconazole, ipconazole, prochloraz, triflumizole, tebuconazole, epoxiconazole, difenoconazole, flusilazole, triadimenol, cyproconazole, metconazole, fluquinconazole, bitertanol, tetraconazole, triticonazole, flutriafol, penconazole, diniconazole, fenbuconazole, bromuconazole, imibenconazole, simeconazole, myclobutanil, hymexazole, imazalil, furametpyr, thifluzamide, etridiazole, oxpoconazole, oxpoconazole fumarate, pefurazoate, prothioconazole, pyrifenox, fenarimol, nuarimol, bupirimate, mepanipyrim, cyprodinil, pyrimethanil, metalaxyl, mefenoxam, oxadixyl, benalaxyl, thiophanate, thiophanate-methyl, benomyl, carbendazim, fuberidazole, thiabendazole, manzeb, propineb, zineb, metiram, maneb, ziram, thiuram, chlorothalonil, ethaboxam, oxycarboxin, carboxin, flutolanil, silthiofam, mepronil, dimethomorph, fenpropidin, fenpropimorph, spiroxamine, tridemorph, dodemorph, flumorph, azoxystrobin, kresoxim-methyl, metominostrobin, orysastrobin, fluoxastrobin, trifloxystrobin, dimoxystrobin, pyraclostrobin, picoxystrobin, iprodione, procymidone, vinclozolin, chlozolinate, flusulfamide, dazomet, methyl isothiocyanate, chloropicrin, methasulfocarb, hydroxyisoxazole, potassium hydroxyisoxazole, echlomezol, D-D, carbam, basic copper chloride, basic copper sulfate, copper nonylphenolsulfonate, oxine copper, DBEDC, anhydrous copper sulfate, copper sulfate pentahydrate, cupric hydroxide, inorganic sulfur, wettable sulfur, lime sulfur, zinc sulfate, fentin, sodium hydrogen carbonate, potassium hydrogen carbonate, sodium hypochlorite, silver, edifenphos, tolclofos-methyl, fosetyl, iprobenfos, dinocap, pyrazophos, carpropamid, fthalide, tricyclazole, pyroquilon, diclocymet, fenoxanil, kasugamycin, validamycin, polyoxins, blasticiden S, oxytetracycline, mildiomycin, streptomycin, rape seed oil, machine oil, benthiavalicarbisopropyl, iprovalicarb, propamocarb, diethofencarb, fluoroimide, fludioxanil, fenpiclonil, quinoxyfen, oxolinic acid, chlorothalonil, captan, folpet, probenazole, acibenzolar-S-methyl, tiadinil, cyflufenamid, fenhexamid, diflumetorim, metrafenone, picobenzamide, proquinazid, famoxadone, cyazofamid, fenamidone, zoxamide, boscalid, cymoxanil, dithianon, fluazinam, dichlofluanide, triforine, isoprothiolane, ferimzone, diclomezine, tecloftalam, pencycuron, chinomethionat, iminoctadine acetate, iminoctadine albesilate, ambam, polycarbamate, thiadiazine, chloroneb, nickel dimethyldithiocarbamate, guazatine, dodecylguanidine-acetate, quintozene, tolylfluanid, anilazine, nitrothalisopropyl, fenitropan, dimethirimol, benthiazole, harpin protein, flumetover, mandipropamide and penthiopyrad.

Polynucleotides

As used herein, the term "DNA", "DNA molecule", "DNA polynucleotide molecule" refers to a single-stranded DNA (ssDNA) or double-stranded DNA (dsDNA) molecule of genomic or synthetic origin, such as, a polymer of deoxyribonucleotide bases or a DNA polynucleotide molecule. As used herein, the term "DNA sequence", "DNA nucleotide sequence" or "DNA polynucleotide sequence" refers to the nucleotide sequence of a DNA molecule. As used herein, the term "RNA", "RNA molecule", "RNA polynucleotide molecule" refers to a single-stranded RNA (ssRNA) or double-stranded RNA (dsRNA) molecule of genomic or synthetic origin, such as, a polymer of ribonucleotide bases that comprise single or double stranded regions. Unless otherwise stated, nucleotide sequences in the text of this specification are given, when read from left to right, in the 5' to 3' direction. The nomenclature used herein is that required by Title 37 of the United States Code of Federal Regulations § 1.822 and set forth in the tables in WIPO Standard ST.25 (1998), Appendix 2, Tables 1 and 3.

As used herein, "polynucleotide" refers to a DNA or RNA molecule containing multiple nucleotides and generally refers both to "oligonucleotides" (a polynucleotide molecule of typically 50 or fewer nucleotides in length) and polynucleotides of 51 or more nucleotides. Embodiments of this invention include compositions including oligonucleotides having a length of 18-25 nucleotides (18-mers, 19-mers, 20-mers, 21-mers, 22-mers, 23-mers, 24-mers, or 25-mers), for example, oligonucleotides SEQ ID NOs: 3901-4530 or fragments thereof or medium-length polynucleotides having a length of 26 or more nucleotides (polynucleotides of 26, 27, 28, 29, 30, 307, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), for example, oligonucleotides SEQ ID NOs: 93-3900 or fragments thereof or long polynucleotides having a length greater than about 300 nucleotides (for example, polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene), for example, polynucleotides of Table 1 (SEQ ID NOs: 1-92) wherein the selected polynucleotides or fragments thereof are homologous or complementary to SEQ ID NOs: 1-92 suppresses, represses or otherwise delay the expression of the target ACCase gene. A target gene comprises any polynucleotide molecule in a plant cell or fragment thereof for which the modulation of the expression of the target gene is provided by the methods and compositions of the present invention. Where a polynucleotide is double-stranded, its length can be similarly described in terms of base pairs. Oligonucleotides and polynucleotides of the present invention can be made that are essentially identical or essentially complementary to adjacent genetic elements of a gene, for example, spanning the junction region of an intron and exon, the junction region of a promoter and a transcribed region, the junction region of a 5' leader and a coding sequence, the junction of a 3' untranslated region and a coding sequence.

Polynucleotide compositions used in the various embodiments of this invention include compositions including oligonucleotides or polynucleotides or a mixture of both, including RNA or DNA or RNA/DNA hybrids or chemically modified oligonucleotides or polynucleotides or a mixture thereof. In some embodiments, the polynucleotide may be a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In some embodiments, the polynucleotide includes non-canonical nucleotides such as inosine, thiouridine, or pseudouridine. In some embodiments, the polynucleotide includes chemically modified nucleotides. Examples of chemically modified oligonucleotides or polynucleotides are well known in the art; see, for example, US Patent Publication 20110171287, US Patent Publication 20110171176, and US Patent Publication 20110152353, US Patent Publication, 20110152346, US Patent Publication 20110160082, herein incorporated by reference. For example, including but not limited to the naturally occurring phosphodiester backbone of an oligonucleotide or polynucleotide can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (for example, fluorescein or rhodamine) or other label (for example, biotin).

The polynucleotides can be single- or double-stranded RNA or single- or double-stranded DNA or double-stranded DNA/RNA hybrids or modified analogues thereof, and can be of oligonucleotide lengths or longer. In more specific embodiments of the invention the polynucleotides that provide single-stranded RNA in the plant cell are selected from the group consisting of (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, and (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, (i) a double-stranded, hybridized RNA/DNA molecule, or combinations thereof. In some embodiments these polynucleotides include chemically modified nucleotides or non-canonical nucleotides. In some embodiments, the oligonucleotides may be blunt-ended or may comprise a 3' overhang of from 1-5 nucleotides of at least one or both of the strands. Other configurations of the oligonucleotide are known in the field and are contemplated herein. In embodiments of the method the polynucleotides include double-stranded DNA formed by intramolecular hybridization, double-stranded DNA formed by intermolecular hybridization, double-stranded RNA formed by intramolecular hybridization, or double-stranded RNA formed by intermolecular hybridization. In one embodiment the polynucleotides include single-stranded DNA or single-stranded RNA that self-hybridizes to form a hairpin structure having an at least partially double-stranded structure including at least one segment that will hybridize to RNA transcribed from the gene targeted for suppression. Not intending to be bound by any mechanism, it is believed that such polynucleotides are or will produce single-stranded RNA with at least one segment that will hybridize to RNA transcribed from the gene targeted for suppression. In certain other embodiments the polynucleotides further includes a promoter, generally a promoter functional in a plant, for example, a pol II promoter, a pol III promoter, a pol IV promoter, or a pol V promoter.

The term "gene" refers to chromosomal DNA, plasmid DNA, cDNA, intron and exon DNA, artificial DNA polynucleotide, or other DNA that encodes a peptide, polypeptide, protein, or RNA transcript molecule, and the genetic elements flanking the coding sequence that are involved in the regulation of expression, such as, promoter regions, 5' leader regions, 3' untranslated regions. Any of the components of the gene are potential targets for the oligonucleotides and polynucleotides of the present invention.

The polynucleotide molecules of the present invention are designed to modulate expression by inducing regulation or suppression of an endogenous ACCase gene in a plant and are designed to have a nucleotide sequence essentially identical or essentially complementary to the nucleotide sequence of an endogenous ACCase gene of a plant or to the sequence of RNA transcribed from an endogenous ACCase gene of a plant, including a transgene in a plant that provides for a herbicide resistant ACCase enzyme, which can be coding sequence or non-coding sequence. Effective molecules that modulate expression are referred to as "a trigger molecule, or trigger polynucleotide". By "essentially identical" or "essentially complementary" is meant that the trigger polynucleotides (or at least one strand of a double-stranded polynucleotide or portion thereof, or a portion of a single strand polynucleotide) are designed to hybridize to the endogenous gene noncoding sequence or to RNA transcribed (known as messenger RNA or an RNA transcript) from the endogenous gene to effect regulation or suppression of expression of the endogenous gene. Trigger molecules are identified by "tiling" the gene targets with partially overlapping probes or non-overlapping probes of antisense or sense polynucleotides that are essentially identical or essentially complementary to the nucleotide sequence of an endogenous gene. Multiple target sequences can be aligned and sequence regions with homology in common, according to the methods of the present invention, are identified as potential trigger molecules for the multiple targets. Multiple trigger molecules of various lengths, for example 18-25 nucleotides, 26-50 nucleotides, 51-100 nucleotides, 101-200 nucleotides, 201-300 nucleotides or more can be pooled into a few treatments in order to investigate polynucleotide molecules that cover a portion of a gene sequence (for example, a portion of a coding versus a portion of a noncoding region, or a 5' versus a 3' portion of a gene) or an entire gene sequence including coding and noncoding regions of a target gene. Polynucleotide molecules of the pooled trigger molecules can be divided into smaller pools or single molecules in order to identify trigger molecules that provide the desired effect.

The target gene RNA and DNA polynucleotide molecules (Table 1, SEQ ID NOs: 1-92) are sequenced by any number of available methods and equipment. Some of the sequencing technologies are available commercially, such as the sequencing-by-hybridization platform from Affymetrix Inc. (Sunnyvale, Calif.) and the sequencing-by-synthesis platforms from 454 Life Sciences (Bradford, Conn.), Illumina/Solexa (Hayward, Calif.) and Helicos Biosciences (Cambridge, Mass.), and the sequencing-by-ligation platform from Applied Biosystems (Foster City, Calif.), as described below. In addition to the single molecule sequencing performed using sequencing-by-synthesis of Helicos Biosciences, other single molecule sequencing technologies are encompassed by the method of the invention and include the SMRT.™. technology of Pacific Biosciences, the Ion Torrent.™. technology, and nanopore sequencing being developed for example, by Oxford Nanopore Technologies. An ACCase target gene comprising DNA or RNA can be isolated using primers or probes essentially complementary or essentially homologous to SEQ ID NOs: 1-92 or a fragment thereof. A polymerase chain reaction (PCR) gene fragment can be produced using primers essentially complementary or essentially homologous to SEQ ID NOs: 1-92 or a fragment thereof that is useful to isolate an ACCase gene from a plant genome. SEQ ID NOs: 1-92 or fragments thereof can be used in various sequence capture technologies to isolate additional target gene sequences, for example, including but not limited to Roche NimbleGen® (Madison, Wis.) and Streptavidin-coupled Dynabeads® (Life Technologies, Grand Island, N.Y.) and US20110015084, herein incorporated by reference in its entirety.

Embodiments of functional single-stranded polynucleotides have sequence complementarity that need not be 100 percent, but is at least sufficient to permit hybridization to RNA transcribed from the target gene or DNA of the target gene to form a duplex to permit a gene silencing mechanism. Thus, in embodiments, a polynucleotide fragment is designed to be essentially identical to, or essentially complementary to, a sequence of 18 or more contiguous nucleotides in either the target ACCase gene sequence or messenger RNA transcribed from the target gene. By "essentially identical" is meant having 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the target gene or RNA transcribed from the target gene; by "essentially complementary" is meant having 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene. In some embodiments of this invention polynucleotide molecules are designed to have 100 percent sequence identity with or complementarity to one allele or one family member of a given target gene (coding or non-coding sequence of a gene for of the present invention); in other embodiments the polynucleotide molecules are designed to have 100 percent sequence identity with or complementarity to multiple alleles or family members of a given target gene.

In certain embodiments, the polynucleotides used in the compositions that are essentially identical or essentially complementary to the target gene or transcript will comprise the predominant nucleic acid in the composition. Thus in certain embodiments, the polynucleotides that are essentially identical or essentially complementary to the target gene or transcript will comprise at least about 50%, 75%, 95%, 98% or 100% of the nucleic acids provided in the composition by either mass or molar concentration. However, in certain embodiments, the polynucleotides that are essentially identical or essentially complementary to the target gene or transcript can comprise at least about 1% to about 50%, about 10% to about 50%, about 20% to about 50%, or about 30% to about 50% of the nucleic acids provided in the composition by either mass or molar concentration. Also provided are compositions where the polynucleotides that are essentially identical or essentially complementary to the target gene or transcript can comprise at least about 1% to 100%, about 10% to 100%, about 20% to about 100%, about 30% to about 50%, or about 50% to a 100% of the nucleic acids provided in the composition by either mass or molar concentration.

"Identity" refers to the degree of similarity between two polynucleic acid or protein sequences. An alignment of the two sequences is performed by a suitable computer program. A widely used and accepted computer program for performing sequence alignments is CLUSTALW v1.6 (Thompson, et al. *Nucl. Acids Res.,* 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between a 200 and a 400 amino acid protein, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Trigger molecules for specific gene family members can be identified from coding and/or non-coding sequences of gene families of a plant or multiple plants, by aligning and selecting 200-300 polynucleotide fragments from the least homologous regions amongst the aligned sequences and evaluated using topically applied polynucleotides (as sense or anti-sense ssDNA or ssRNA, dsRNA, or dsDNA) to determine their relative effectiveness in inducing the herbicidal phenotype. The effective segments are further subdivided into 50-60 polynucleotide fragments, prioritized by least homology, and reevaluated using topically applied polynucleotides. The effective 50-60 polynucleotide fragments are subdivided into 19-30 polynucleotide fragments, prioritized by least homology, and again evaluated for induction of the yield/quality phenotype. Once relative effectiveness is determined, the fragments are utilized singly, or again evaluated in combination with one or more other fragments to determine the trigger composition or mixture of trigger polynucleotides for providing the yield/quality phenotype.

Trigger molecules for broad activity can be identified from coding and/or non-coding sequences of gene families of a plant or multiple plants, by aligning and selecting 200-300 polynucleotide fragments from the most homologous regions amongst the aligned sequences and evaluated using topically applied polynucleotides (as sense or antisense ssDNA or ssRNA, dsRNA, or dsDNA) to determine their relative effectiveness in inducing the yield/quality phenotype. The effective segments are subdivided into 50-60 polynucleotide fragments, prioritized by most homology, and reevaluated using topically applied polynucleotides. The effective 50-60 polynucleotide fragments are subdivided into 19-30 polynucleotide fragments, prioritized by most homology, and again evaluated for induction of the yield/quality phenotype. Once relative effectiveness is determined, the fragments may be utilized singly, or in combination with one or more other fragments to determine the trigger composition or mixture of trigger polynucleotides for providing the yield/quality phenotype.

Methods of making polynucleotides are well known in the art. Chemical synthesis, in vivo synthesis and in vitro synthesis methods and compositions are known in the art and include various viral elements, microbial cells, modified polymerases, and modified nucleotides. Commercial preparation of oligonucleotides often provides two deoxyribonucleotides on the 3' end of the sense strand. Long polynucleotide molecules can be synthesized from commercially available kits, for example, kits from Applied Biosystems/Ambion (Austin, Tex.) have DNA ligated on the 5' end in a microbial expression cassette that includes a bacterial T7 polymerase promoter that makes RNA strands that can be assembled into a dsRNA and kits provided by various manufacturers that include T7 RiboMax Express (Promega, Madison, Wis.), AmpliScribe T7-Flash (Epicentre, Madison, Wis.), and TranscriptAid T7 High Yield (Fermentas, Glen Burnie, Md.). dsRNA molecules can be produced from microbial expression cassettes in bacterial cells (Ongvarrasopone et al. Science Asia 33:35-39; Yin, *Appl. Microbiol. Biotechnol.* 84: 323-333, 2009; Liu et al., BMC Biotechnology 10:85, 2010) that have regulated or deficient RNase III enzyme activity or the use of various viral vectors to produce sufficient quantities of dsRNA. In the present invention, ACCase gene fragments are inserted into the microbial expression cassettes in a position in which the fragments are express to produce ssRNA or dsRNA useful in the methods described herein to regulate expression on a target ACCase gene. In some embodiments design parameters such as Reynolds score (Reynolds et al. *Nature Biotechnology* 22, 326-330 (2004), Tuschl rules (Pei and Tuschl, *Nature Methods* 3(9): 670-676, 2006), i-score (Nucleic Acids Res 35: e123, 2007), i-Score Designer tool and associated algorithms (*Nucleic Acids Res* 32: 936-948, 2004. *Biochem Biophys Res Commun* 316: 1050-1058, 2004, *Nucleic Acids Res* 32: 893-901, 2004, *Cell Cycle* 3: 790-5, 2004, *Nat Biotechnol* 23: 995-1001, 2005, *Nucleic Acids Res* 35: e27, 2007, *BMC Bioinformatics* 7: 520, 2006, *Nucleic Acids Res* 35: e123, 2007, *Nat Biotechnol* 22: 326-330, 2004) are known in the art and may be used in selecting polynucleotide sequences effective in gene silencing. In some embodiments the sequence of a polynucleotide is screened against the genomic DNA of the intended plant to minimize unintentional silencing of other genes.

The trigger polynucleotide and oligonucleotide molecule polynucleotide compositions are useful in compositions, such as liquids that comprise these of polynucleotide molecules, at low concentrations, alone or in combination with other components, for example one or more herbicide molecules, either in the same solution or in separately applied liquids that also provide a transfer agent. While there is no upper limit on the concentrations and dosages of polynucleotide molecules that can useful in the methods of this invention, lower effective concentrations and dosages will generally be sought for efficiency. The concentrations can be adjusted in consideration of the volume of spray or treatment applied to plant leaves or other plant part surfaces, such as flower petals, stems, tubers, fruit, anthers, pollen, or seed. In one embodiment, a useful treatment for herbaceous plants using 25-mer oligonucleotide molecules is about 1 nanomole (nmol) of oligonucleotide molecules per plant, for example, from about 0.05 to 1 nmol per plant. Other embodiments for herbaceous plants include useful ranges of about 0.05 to about 100 nmol, or about 0.1 to about 20 nmol, or about 1 nmol to about 10 nmol of polynucleotides per plant. Very large plants, trees, or vines may require correspondingly larger amounts of polynucleotides. When using long dsRNA molecules that can be processed into multiple oligonucleotides, lower concentrations can be used. To illustrate embodiments of the invention, the factor 1×, when applied to oligonucleotide molecules is arbitrarily used to denote a treatment of 0.8 nmol of polynucleotide molecule per plant; 10×, 8 nmol of polynucleotide molecule per plant; and 100×, 80 nmol of polynucleotide molecule per plant.

The polynucleotide compositions of this invention are useful in compositions, such as liquids that comprise polynucleotide molecules, alone or in combination with other components either in the same liquid or in separately applied liquids that provide a transfer agent. As used herein, a transfer agent is an agent that, when combined with a polynucleotide in a composition that is topically applied to a target plant surface, enables the polynucleotide to enter a plant cell. In certain embodiments, a transfer agent is an agent that conditions the surface of plant tissue, e.g., leaves, stems, roots, flowers, or fruits, to permeation by the polynucleotide molecules into plant cells. The transfer of polynucleotides into plant cells can be facilitated by the prior or contemporaneous application of a polynucleotide-transferring agent to the plant tissue. In some embodiments the transferring agent is applied subsequent to the application of the polynucleotide composition. The polynucleotide transfer agent enables a pathway for polynucleotides through cuticle wax barriers, stomata and/or cell wall or membrane barriers into plant cells. Suitable transfer agents to facilitate transfer of the polynucleotide into a plant cell include agents that increase permeability of the exterior of the plant or that increase permeability of plant cells to oligonucleotides or polynucleotides. Such agents to facilitate transfer of the composition into a plant cell include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. Embodiments of the method can optionally include an incubation step, a neutralization step (e.g., to neutralize an acid, base, or oxidizing agent, or to inactivate an enzyme), a rinsing step, or combinations thereof. Embodiments of agents or treatments for conditioning of a plant to permeation by polynucleotides include emulsions, reverse emulsions, liposomes, and other micellar-like compositions. Embodiments of agents or treatments for conditioning of a plant to permeation by polynucleotides include counter-ions or other molecules that are known to associate with nucleic acid molecules, e.g., inorganic ammonium ions, alkyl ammonium ions, lithium ions, polyamines such as spermine, spermidine, or putrescine, and other cations. Organic solvents useful in conditioning a plant to permeation by polynucleotides include DMSO, DMF, pyridine, N-pyrrolidine, hexamethylphosphoramide, acetonitrile, dioxane, polypropylene glycol, other solvents miscible with water or that will dissolve phosphonucleotides in non-aqueous systems (such as is used in synthetic reactions). Naturally derived or synthetic oils with or without surfactants or emulsifiers can be used, e.g., plant-sourced oils, crop oils (such as those listed in the 9th Compendium of Herbicide Adjuvants, publicly available on the worldwide web (internet) at herbicide.adjuvants.com can be used, e.g., paraffinic oils, polyol fatty acid esters, or oils with short-chain molecules modified with amides or polyamines such as polyethyleneimine or N-pyrrolidine. Transfer agents include, but are not limited to, organosilicone preparations.

In certain embodiments, an organosilicone preparation that is commercially available as Silwet® L-77 surfactant having CAS Number 27306-78-1 and EPA Number: CAL. REG. NO. 5905-50073-AA, and currently available from Momentive Performance Materials, Albany, N.Y. can be used to prepare a polynucleotide composition. In certain embodiments where a Silwet L-77 organosilicone preparation is used as a pre-spray treatment of plant leaves or other plant surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation comprising Silwet L-77 in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

In certain embodiments, any of the commercially available organosilicone preparations provided such as the following Breakthru S 321, Breakthru S 200 Cat #67674-67-3, Breakthru OE 441 Cat #68937-55-3, Breakthru S 278 Cat #27306-78-1, Breakthru S 243, Breakthru S 233 Cat #134180-76-0, available from manufacturer Evonik Goldschmidt (Germany), Silwet® HS 429, Silwet® HS 312, Silwet® HS 508, Silwet® HS 604 (Momentive Performance Materials, Albany, N.Y.) can be used as transfer agents in a polynucleotide composition. In certain embodiments where an organosilicone preparation is used as a pre-spray treatment of plant leaves or other surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Organosilicone preparations used in the methods and compositions provided herein can comprise one or more effective organosilicone compounds. As used herein, the phrase "effective organosilicone compound" is used to describe any organosilicone compound that is found in an organosilicone preparation that enables a polynucleotide to enter a plant cell. In certain embodiments, an effective organosilicone compound can enable a polynucleotide to enter a plant cell in a manner permitting a polynucleotide mediated suppression of a target gene expression in the plant cell. In general, effective organosilicone compounds include, but are not limited to, compounds that can comprise: i) a trisiloxane head group that is covalently linked to, ii) an alkyl linker including, but not limited to, an n-propyl linker, that is covalently linked to, iii) a poly glycol chain, that is covalently linked to, iv) a terminal group. Trisiloxane head groups of such effective organosilicone compounds include, but are not limited to, heptamethyltrisiloxane. Alkyl linkers can include, but are not limited to, an n-propyl linker. Poly glycol chains include, but are not limited to, polyethylene glycol or polypropylene glycol. Poly glycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Effective organosilicone compounds are believed to include, but are not limited to, trisiloxane ethoxylate surfactants or polyalkylene oxide modified heptamethyl trisiloxane.

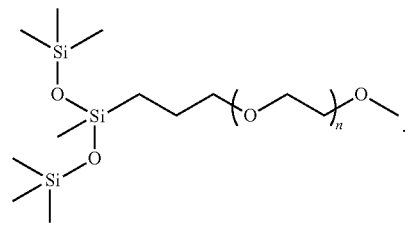

(Compound I: polyalkyleneoxide heptamethyltrisiloxane, average n = 7.5)

In certain embodiments, an organosilicone preparation that comprises an organosilicone compound comprising a trisiloxane head group is used in the methods and compositions provided herein. In certain embodiments, an organosilicone preparation that comprises an organosilicone compound comprising a heptamethyltrisiloxane head group is used in the methods and compositions provided herein. In certain embodiments, an organosilicone composition that comprises Compound I is used in the methods and compositions provided herein. In certain embodiments, an organosilicone composition that comprises Compound I is used in the methods and compositions provided herein. In certain embodiments of the methods and compositions provided herein, a composition that comprises a polynucleotide molecule and one or more effective organosilicone compound in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Compositions include but are not limited components that are one or more polynucleotides essentially identical to, or essentially complementary to an ACCase gene sequence (promoter, intron, exon, 5' untranslated region, 3' untranslated region), a transfer agent that provides for the polynucleotide to enter a plant cell, a herbicide that complements the action of the polynucleotide, one or more additional herbicides that further enhance the herbicide activity of the composition or provide an additional mode of action different from the complementing herbicide, various salts and stabilizing agents that enhance the utility of the composition as an admixture of the components of the composition.

Methods include one or more applications of a polynucleotide composition and one or more applications of a permeability-enhancing agent for conditioning of a plant to permeation by polynucleotides. When the agent for conditioning to permeation is an organosilicone composition or compound contained therein, embodiments of the polynucleotide molecules are double-stranded RNA oligonucleotides, single-stranded RNA oligonucleotides, double-stranded RNA polynucleotides, single-stranded RNA polynucleotides, double-stranded DNA oligonucleotides, single-stranded DNA oligonucleotides, double-stranded DNA polynucleotides, single-stranded DNA polynucleotides, chemically modified RNA or DNA oligonucleotides or polynucleotides or mixtures thereof.

Compositions and methods are useful for modulating the expression of an endogenous ACCase gene (for example, U.S. Pat. No. 7,297,541, U.S. Patent Publ. 20110185444, and 20110185445) or transgenic ACCase gene (for example, U.S. Pat. No. 7,3072,379, U.S. Patent Publ. 20110191897) or ACCase inhibitor inactivating genes (U.S. Pat. Nos. 6,268,549; 6,768,044; 7,3072,379; 7,304,209; WO 96/38567, WO 99/24585) in a plant cell. In various embodiments, an ACCase gene includes coding (protein-coding or translatable) sequence, non-coding (non-translatable) sequence, or both coding and non-coding sequence. Compositions of the invention can include polynucleotides and oligonucleotides designed to target multiple genes, or multiple segments of one or more genes. The target gene can include multiple consecutive segments of a target gene, multiple non-consecutive segments of a target gene, multiple alleles of a target gene, or multiple target genes from one or more species.

An aspect of the invention provides a method for modulating expression of an ACCase gene in a plant including (a) conditioning of a plant to permeation by polynucleotides and (b) treatment of the plant with the polynucleotide molecules, wherein the polynucleotide molecules include at least one segment of 18 or more contiguous nucleotides cloned from or otherwise identified from the target ACCase gene in either anti-sense or sense orientation, whereby the polynucleotide molecules permeate the interior of the plant and induce modulation of the target gene. The conditioning and polynucleotide application can be performed separately or in a single step. When the conditioning and polynucleotide application are performed in separate steps, the conditioning can precede or can follow the polynucleotide application within minutes, hours, or days. In some embodiments more than one conditioning step or more than one polynucleotide molecule application can be performed on the same plant. In embodiments of the method, the segment can be cloned or identified from (a) coding (protein-encoding), (b) non-coding (promoter and other gene related molecules), or (c) both coding and non-coding parts of the target gene. Non-coding parts include DNA, such as promoter regions or the RNA transcribed by the DNA that provide RNA regulatory molecules, including but not limited to: introns, 5' or 3' untranslated regions, and microRNAs (miRNA), trans-acting siR-NAs, natural anti-sense siRNAs, and other small RNAs with regulatory function or RNAs having structural or enzymatic function including but not limited to: ribozymes, ribosomal RNAs, t-RNAs, aptamers, and riboswitches.

All publications, patents and patent applications are herein incorporated by reference to the same extent as if each individual publication or patent application was specifically and individually indicated to be incorporated by reference.

The following examples are included to demonstrate examples of certain preferred embodiments of the invention. It should be appreciated by those of skill in the art that the techniques disclosed in the examples that follow represent approaches the inventors have found function well in the practice of the invention, and thus can be considered to constitute examples of preferred modes for its practice. However, those of skill in the art should, in light of the present disclosure, appreciate that many changes can be made in the specific embodiments that are disclosed and still obtain a like or similar result without departing from the spirit and scope of the invention.

EXAMPLES

Example 1. Polynucleotides Related to the ACCase Gene Sequences

The target ACCase polynucleotide molecule naturally occurs in the genome of *Amaranthus palmeri, Amaranthus rudis, Amaranthsu chlorostachys, Amaranthus thunbergii, Amaranthus graecizans, Amaranthus hybridus, Amaranthus lividus, Amaranthus spinosus, theophrasti, Ambrosia trifida, Commelina diffusa, Conyza canadensis, Lolium multiflorum, Sorghum halepense, Xanthium strumarium, Euphorbia heterophylla, Kochia scoparia*, and *Digitaria sanguinalis*, and include molecules related to the expression of a polypeptide identified as an ACCase, that include regulatory molecules, cDNAs comprising coding and noncoding regions of an ACCase gene and fragments thereof as shown in Table 1.

Polynucleotide molecules were extracted from these plant species by methods standard in the field, for example, total RNA is extracted using TRIZOL® reagent (Invitrogen Corp, Carlsbad, Calif., Cat. No. 15596-018; a monophasic solution of phenol and guanidine isothiocyanate) following the manufacturer's protocol or modifications thereof by those skilled in the art of polynucleotide extraction that may enhance recover or purity of the extracted RNA. Briefly, start with 1 gram of ground plant tissue for extraction. Prealiquot 10 milliliters (mL) TRIZOL® reagent to 15 mL conical tubes. Add ground powder to tubes and shake to homogenize. Incubate the homogenized samples for 5 minutes (min) at room temperature (RT) and then add 3 mL of chloroform. Shakes tubes vigorously by hand for 15-30 seconds (sec) and incubate at RT for 3 min. Centrifuge the tubes at 7,000 revolutions per minute (rpm) for 10 min at 4 degrees C. Transfer the aqueous phase to a new 1.5 mL tube and add 1 volume of cold isopropanol. Incubate the samples for 20-30 min at RT and centrifuge at 10,000 rpm for 10 min at 4 degrees C. Wash pellet with Sigma-grade 80 percent ethanol. Remove the supernatant and briefly air-dry the pellet. Dissolve the RNA pellet in approximately 200 microliters of DEPC treated water. Heat briefly at 65 degrees C. to dissolve pellet and vortex or pipet to resuspend RNA pellet. Adjust RNA concentration to 1-2 microgram/microliter.

DNA was extracted using EZNA SP Plant DNA Mini kit (Omega Biotek, Norcross Ga., Cat # D5511) and Lysing Matrix E tubes (Q-Biogen, Cat #6914), following the manufacturer's protocol or modifications thereof by those skilled in the art of polynucleotide extraction that may enhance recover or purity of the extracted DNA. Briefly, aliquot ground tissue to a Lysing Matrix E tube on dry ice, add 800 µl Buffer SP1 to each sample, homogenize in a bead beater for 35-45 sec, incubate on ice for 45-60 sec, centrifuge at ≥14000 rpm for 1 min at RT, add 10 microliter RNase A to the lysate, incubate at 65° C. for 10 min, centrifuge for 1 min at RT, add 280 µl Buffer SP2 and vortex to mix, incubate the samples on ice for 5 min, centrifuge at ≥10,000 g for 10 min at RT, transfer the supernatant to a homogenizer column in a 2 ml collection tube, centrifuge at 10,000 g for 2 min at RT, transfer the cleared lysate into a 1.5 ml microfuge tube, add 1.5 volumes Buffer SP3 to the cleared lysate, vortex immediately to obtain a homogeneous mixture, transfer up to 650 µl supernatant to the Hi-Bind column, centrifuge at 10,000 g for 1 min, repeat, apply 100 µl 65° C. Elution Buffer to the column, centrifuge at 10,000 g for 5 min at RT.

Next-generation DNA sequencers, such as the 454-FLX (Roche, Branford, Conn.), the SOLiD (Applied Biosystems), and the Genome Analyzer (HiSeq2000, Illumina, San Diego, Calif.) were used to provide polynucleotide sequence from the DNA and RNA extracted from the plant tissues. Raw sequence data is assembled into contigs. The contig sequence is used to identify trigger molecules that can be applied to the plant to enable regulation of the gene expression. The target DNA sequence isolated from genomic (gDNA) and coding DNA (cDNA) from the various weedy plant species for the ACCase gene and the assembled contigs were set forth in SEQ ID NOs: 1-92 and Table 1.

Example 2. Polynucleotides of the Invention Related to the Trigger Molecules

The gene sequences and fragments of Table 1 were divided into 200 polynucleotide (200-mer) lengths with 25 polynucleotide overlapping regions (SEQ ID NOs: 93-3900). These polynucleotides are tested to select the most efficacious trigger regions across the length of any target sequence. The trigger polynucleotides are constructed as sense or anti-sense ssDNA or ssRNA, dsRNA, or dsDNA, or dsDNA/RNA hybrids and combined with an organosilicone based transfer agent to provide a polynucleotide preparation. The polynucleotides are combined into sets of two to three polynucleotides per set, using 4-8 nmol of each polynucleotide. Each polynucleotide set is prepared with the transfer agent and applied to a plant or a field of plants in combination with a ACCase inhibitor containing herbicide, or followed by a ACCase inhibitor treatment one to three days after the polynucleotide application, to determine the effect on the plant's susceptibility to an ACCase inhibitor. The effect is measured as stunting the growth and/or killing of the plant and is measured 8-14 days after treatment with the polynucleotide set and ACCase inhibitor. The most efficacious sets are identified and the individual polynucleotides are tested in the same methods as the sets are and the most efficacious single 200-mer identified. The 200-mer sequence is divided into smaller sequences of 50-70-mer regions with 10-15 polynucleotide overlapping regions and the polynucleotides tested individually. The most efficacious 50-70-mer is further divided into smaller sequences of 25-mer regions with a 12 to 13 polynucleotide overlapping region and tested for efficacy in combination with ACCase inhibitor treatment. By this method it is possible to identify an oligonucleotide or several oligonucleotides that are the most efficacious trigger molecule to effect plant sensitivity to an ACCase inhibitor or modulation of an ACCase gene expression. The modulation of ACCase gene expression is determined by the detection of ACCase siRNA molecules specific to an ACCase gene or by an observation of a reduction in the amount of ACCase RNA transcript produced relative to an untreated plant or by merely observing the anticipated phenotype of the application of the trigger with the ACCase inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the ACCase gene and the assembled contigs were set forth in SEQ ID NOs: 1-92 were divided into polynucleotide fragments as set forth in SEQ ID NOs: 93-3900.

The gene sequences and fragments of Table 1 were compared and 21-mers of contiguous polynucleotides were identified that have homology across the various ACCase gene sequences. The purpose was to identify trigger molecules that are useful as herbicidal molecules or in combination with an ACCase inhibitor herbicide across a broad range of weed species. The sequences, SEQ ID NOs: 3901-4530 represent the 21-mers that are present in the ACCase gene of at least eight of the weed species of Table 1. It is contemplated that additional 21-mers can be selected from the sequences of Table 1 that are specific for a single weed species or a few weeds species within a genus or trigger molecules that are at least 18 contiguous nucleotides, at least 19 contiguous nucleotides, at least 20 contiguous nucleotides or at least 21 contiguous nucleotides in length and at least 85 percent identical to an ACCase gene sequence selected from the group consisting of SEQ ID NOs: 1-92 or fragment thereof.

By this method it is possible to identify an oligonucleotide or several oligonucleotides that are the most efficacious trigger molecule to effect plant sensitivity to ACCase inhibitor or modulation of ACCase gene expression. The modulation of ACCase gene expression is determined by the detection of ACCase siRNA molecules specific to ACCase gene or by an observation of a reduction in the amount of ACCase RNA transcript produced relative to an untreated plant or by merely observing the anticipated phenotype of the application of the trigger with the ACCase inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the ACCase gene and the assembled contigs as set forth in SEQ ID NOs: 1-92 were divided into fragments as set forth in SEQ ID NOs: 3901-4530.

Example 3. Methods Used in the Invention Related to Treating Plants or Plant Parts with a Topical Mixture of the Trigger Molecules Glyphosate-sensitive Palmer amaranth (*A. palmeri* R-22) plants where grown in the greenhouse (30/20 C day/night T; 14 hour photoperiod) in 4 inch square pots containing Sun Gro® Redi-Earth and 3.5 kg/cubic meter Osmocote® 14-14-14 fertilizer. Palmer amaranth plants at 5 to 10 cm in height were treated with a pool of eight 8 short (21-22mer) single-strand antisense oligo DNA polynucleotides (ssDNA) targeting ACCase shown in Table 2 at 16 nmol, formulated in 10 millimolar sodium phosphate buffer (pH 6.8) containing 2% ammonium sulfate and 0.5% Silwet L-77. Plants were treated manually by pipetting 10 µL of polynucleotide solution on four fully expanded mature leaves, for a total of 40 microliters of solution per plant. Twenty-four and forty-eight hours later, the plants were treated with clethodim (SelectMax®, 0.97 lb ai per gallon; ACCase inhibitor) at 272 g ai/ha, crop oil concentrate (COC) at 1% was added to the herbicide treatments. Four replications of each treatment were conducted. Plant height was determined just before ssDNA treatment and at intervals upto twelve days after herbicide treatments to determine effect of the oligonucleotide and herbicide treatments.

TABLE 2 ssDNA ACCase oligonucleotides

| OLIGO1 | SEQ ID NO: 4531 | gtcttacaagggttctcaa |
| OLIGO2 | SEQ ID NO: 4532 | ATCTATGTTCACCTCCCTGTG |
| OLIGO3 | SEQ ID NO: 4533 | ATAAACCATTAGCTTTCCcGG |
| OLIGO4 | SEQ ID NO: 4534 | TTtATtGgAaCAaGCGgAgTT |
| OLIGO5 | SEQ ID NO: 4535 | TATAGCACCACTTCCCGATAG |
| OLIGO6 | SEQ ID NO: 4536 | GCACCACGAGGATCACAAGAA |
| OLIGO7 | SEQ ID NO: 4537 | CCACCCGAGAAACCTCTCCAA |
| OLIGO8 | SEQ ID NO: 4538 | CAGTCTTGaCGAGTGATTCCT |

The results of the treatments are shown in FIG. 1 and demonstrated that plants treated with 16 nmol and the clethodim herbicide caused 22 percent reduction in plant height relative to the untreated control and clethodim alone caused 0 percent reduction in plant height. Surprising result since dicot plants are not normally sensitive to ACCase inhibitor herbicides.

An additional test was conducted to determine which of the ACCase oligonucleotides was responsible for the result. In this test, each oligonucleotide was applied to four plants at 4 nmol (nanomole) per plant, the herbicide was applied 24 hours after the oligonucleotide treatment and the plants were rated for growth effects. This followup test identified that formulated oligo6 (SEQ ID NO: 4536) had the largest effect and was able to reduce the plant growth by and average of 40 percent relative to untreated plants. This result provides an opportunity to broaden the spectrum of use for ACCas inhibitor herbicides to include dicot weeds.

Example 4. A Method to Control Weeds in a Field

A method to control weeds in a field comprises the use of trigger polynucleotides that can modulate the expression of an ACCase gene in one or more target weed plant species. An analysis of ACCase gene sequences from seventeen plant species provided a collection of 21-mer polynucleotides that can be used in compositions to affect the growth or develop or sensitivity to ACCase inhibitor herbicide to control multiple weed species in a field. A composition containing 1 or 2 or 3 or 4 or more of the polynucleotides of SEQ ID NOs: 3901-4530 would enable broad activity of the composition against the multiple weed species that occur in a field environment.

The method includes creating a composition that comprises components that include at least one polynucleotide of SEQ ID NOs: 3901-4530 or any other effective gene expression modulating polynucleotide essentially identical or essentially complementary to SEQ ID NOs: 1-92 or fragment thereof, a transfer agent that mobilizes the polynucleotide into a plant cell and a ACCase inhibiting herbicide and optionally a polynucleotide that modulates the expression of an essential gene and optionally a herbicide that has a different mode of action relative to an ACCase inhibitor. The polynucleotide of the composition includes a dsRNA, ssDNA or dsDNA or a combination thereof. A composition containing a polynucleotide can have a use rate of about 1 to 30 grams or more per acre depending on the size of the polynucleotide and the number of polynucleotides in the composition. The composition may include one or more additional herbicides as needed to provide effective multi-species weed control. A field of crop plants in need of weed plant control is treated by spray application of the composition. The composition can be provided as a tank mix, a sequential treatment of components (generally the polynucleotide followed by the herbicide), a simultaneous treatment or mixing of one or more of the components of the composition from separate containers. Treatment of the field can occur as often as needed to provide weed control and the components of the composition can be adjusted to target specific weed species or weed families.

TABLE 1

ACCase gene sequences isolated from weedy plant species

| SEQ ID NO | SPECIES | TYPE | LENGTH |
|---|---|---|---|
| 1 | Abutilon theophrasti | cDNAContig | 1036 |
| 2 | Amaranthus graecizans | cDNAContig | 1479 |
| 3 | Amaranthus graecizans | cDNAContig | 638 |
| 4 | Amaranthus hybridus | cDNAContig | 2174 |
| 5 | Amaranthus hybridus | cDNAContig | 530 |
| 6 | Amaranthus hybridus | cDNAContig | 527 |
| 7 | Amaranthus lividus | cDNAContig | 1310 |
| 8 | Amaranthus lividus | cDNAContig | 1309 |
| 9 | Amaranthus lividus | cDNAContig | 638 |
| 10 | Amaranthus palmeri | cDNAContig | 4689 |
| 11 | Amaranthus palmeri | cDNAContig | 1582 |
| 12 | Amaranthus palmeri | cDNAContig | 822 |
| 13 | Amaranthus palmeri | gDNAContig | 17981 |
| 14 | Amaranthus palmeri | gDNAContig | 9312 |
| 15 | Amaranthus palmeri | gDNAContig | 5302 |
| 16 | Amaranthus palmeri | gDNAContig | 1693 |
| 17 | Amaranthus palmeri | gDNAContig | 1457 |
| 18 | Amaranthus palmeri | gDNAContig | 1175 |
| 19 | Amaranthus rudis | cDNAContig | 5038 |
| 20 | Amaranthus rudis | cDNAContig | 1529 |
| 21 | Amaranthus rudis | cDNAContig | 1103 |
| 22 | Amaranthus rudis | cDNAContig | 541 |
| 23 | Amaranthus rudis | gDNAContig | 1511 |
| 24 | Amaranthus rudis | gDNAContig | 1246 |
| 25 | Amaranthus rudis | gDNAContig | 780 |
| 26 | Amaranthus rudis | gDNAContig | 342 |
| 27 | Amaranthus spinosus | cDNAContig | 755 |
| 28 | Amaranthus spinosus | cDNAContig | 605 |
| 29 | Amaranthus spinosus | cDNAContig | 577 |
| 30 | Amaranthus thunbergii | cDNAContig | 1492 |
| 31 | Amaranthus thunbergii | cDNAContig | 1214 |
| 32 | Amaranthus thunbergii | cDNAContig | 1121 |
| 33 | Amaranthus viridis | cDNAContig | 5705 |
| 34 | Ambrosia trifida | cDNAContig | 2186 |
| 35 | Ambrosia trifida | cDNAContig | 1838 |
| 36 | Ambrosia trifida | cDNAContig | 818 |

TABLE 1-continued

ACCase gene sequences isolated from weedy plant species

| SEQ ID NO | SPECIES | TYPE | LENGTH |
|---|---|---|---|
| 37 | Ambrosia trifida | cDNAContig | 505 |
| 38 | Ambrosia trifida | gDNAContig | 4795 |
| 39 | Ambrosia trifida | gDNAContig | 4587 |
| 40 | Ambrosia trifida | gDNAContig | 2723 |
| 41 | Ambrosia trifida | gDNAContig | 2408 |
| 42 | Ambrosia trifida | gDNAContig | 1771 |
| 43 | Ambrosia trifida | gDNAContig | 1320 |
| 44 | Conyza canadensis | cDNAContig | 7026 |
| 45 | Conyza canadensis | cDNAContig | 6912 |
| 46 | Conyza canadensis | cDNAContig | 6654 |
| 47 | Conyza canadensis | cDNAContig | 4804 |
| 48 | Conyza canadensis | cDNAContig | 454 |
| 49 | Conyza canadensis | gDNAContig | 19367 |
| 50 | Conyza canadensis | gDNAContig | 17803 |
| 51 | Conyza canadensis | gDNAContig | 16098 |
| 52 | Euphorbia heterophylla | cDNAContig | 2292 |
| 53 | Euphorbia heterophylla | cDNAContig | 1338 |
| 54 | Euphorbia heterophylla | cDNAContig | 1250 |
| 55 | Euphorbia heterophylla | cDNAContig | 959 |
| 56 | Euphorbia heterophylla | cDNAContig | 935 |
| 57 | Euphorbia heterophylla | gDNAContig | 12503 |
| 58 | Euphorbia heterophylla | gDNAContig | 5227 |
| 59 | Euphorbia heterophylla | gDNAContig | 4102 |
| 60 | Euphorbia heterophylla | gDNAContig | 1523 |
| 61 | Xanthium strumarium | cDNAContig | 1349 |
| 62 | Commelina diffusa | cDNAContig | 7098 |
| 63 | Commelina diffusa | gDNAContig | 14748 |
| 64 | Commelina diffusa | gDNAContig | 3209 |
| 65 | Digitaria sanguinalis | cDNAContig | 1629 |
| 66 | Digitaria sanguinalis | cDNAContig | 1468 |
| 67 | Digitaria sanguinalis | cDNAContig | 1194 |
| 68 | Digitaria sanguinalis | cDNAContig | 586 |
| 69 | Digitaria sanguinalis | cDNAContig | 488 |
| 70 | Digitaria sanguinalis | gDNAContig | 10084 |
| 71 | Digitaria sanguinalis | gDNAContig | 2626 |
| 72 | Digitaria sanguinalis | gDNAContig | 2351 |
| 73 | Digitaria sanguinalis | gDNAContig | 2088 |
| 74 | Digitaria sanguinalis | gDNAContig | 1983 |
| 75 | Kochia scoparia | cDNAContig | 7122 |
| 76 | Kochia scoparia | gDNAContig | 17930 |
| 77 | Kochia scoparia | gDNAContig | 12931 |
| 78 | Kochia scoparia | gDNAContig | 10030 |
| 79 | Kochia scoparia | gDNAContig | 8717 |
| 80 | Kochia scoparia | gDNAContig | 6978 |
| 81 | Kochia scoparia | gDNAContig | 4017 |
| 82 | Kochia scoparia | gDNAContig | 2591 |
| 83 | Kochia scoparia | gDNAContig | 704 |
| 84 | Lolium multiflorum | cDNAContig | 842 |
| 85 | Lolium multiflorum | cDNAContig | 732 |
| 86 | Lolium multiflorum | cDNAContig | 668 |
| 87 | Lolium multiflorum | cDNAContig | 469 |
| 88 | Lolium multiflorum | gDNAContig | 4094 |
| 89 | Lolium multiflorum | gDNAContig | 3198 |
| 90 | Lolium multiflorum | gDNAContig | 511 |
| 91 | Lolium multiflorum | gDNAContig | 252 |
| 92 | Sorghum halepense | cDNAContig | 1913 |

SEQUENCE LISTING (4538 sequences)

SEQ ID NO: 1 - DNA, 1036 bp, Abutilon theophrasti
ttgctgtaactgatcttgcctgcagtaagaaactgcctttaatttatttggctgcgaactctggtgctcgtattggggtagctgaagaagtcaaagcctgctttaaagttggttggtctgatgaatccagccctgagcgtggttttcagtacatttacataactcctgaggattatactaggattggatcatcggtcattgcacatgagatgaagctggccagtggagagagcagatgggtgatagatactattgttgggaaggaggatggtttgggggatcgagaacttaacaggtagtggagccattgctggtgcatactctcgggcatacaaagaaacctttaccctaacgtatgtgactggtagaactgtgggaattggtgcttatcttgctcgtcttggcatgcggtgtatacaaagactcgatcaacccattattttgactggtttctcagcattgaacaaacttctaggtcgtgaggtgtatagctcccacatgcaacttggtggacctaaaatcatggcaacaaatggggtggttcatctcaccgtctcagatgatcttgaaggggtgtcagctattttgaactggataagttgcatacctcctcatattggtggtccacttcccattttaaacccatcagatcctccagaaaggcctgtggagtacatcccggaaaattcatgtgatcctcgtgccgctatttgtggtgctttagatagtaatggcaagtggaagggcggtatttttgacagggatagctttgtggagacgctcgaaggttgggctagaacagttgtcacaggaagggcaaagcttggaggaattcctgcaggaatagttgcagttgagacacagacggtgatgcaggttatccctgccgatccaggacaacttgattcccatgaaagagttgtccctcaagctggacaggtatggtttccggattctgctacaaagacagctcaggcaataatggatttcaacagggaagagcttccacttttcattcttgccaattggagaggct

SEQ ID NO: 2 - DNA, 1479 bp, Amaranthus graecizans
accacgagaagatgctttcttccttgcggttacaaatcttgcttgtgcgaagaaacttcctcttatttatctggctgcaaattcaggagctcgacttggtgttgccgaagagctaaaatcctgctttaaagttggctggtcggatgagtcaaaccccgagagtggatttcagtatgtcttcttaaccccggaagattacgatcgtatcggatcgtcagtcatagcccacgagttaaaactcgaaagtggagaaaaaagatgggttatagacacagttgtcggaaaggaggacggattaggtgtcgagaatctatcaggaagtggtgctatagccagtgcatactcaagggcttacaaggaaacatttactctgacttttgtaactggtagaacggtcggtattggtgcctatcttgctcgccttgggatgcgttgtatacagaggcttgaccagcctataattctcacgggtttttctgcgttaaataaacttcttggtcgggaggtttacagttcacacatgcaacttggtggaccgaagattatgggcacaaacggggtagttcatcttacagtttccgatgatcttgaaggcatttcatctatcttgaagtggctgagctatgttccaccctatgcaggtggtgaacttccgatttctcggtgtttagaccctccagaaagacccgttgcgtatttgcctgaaaattcttgtgatcctcgtggtgctatatctggtacagttgactccaccggtaaatggcatgggggtattttcgacaaggatagttttgtggaaaccttagaaggctgggcacgaacagttgtcacgggaagggctaaacttggaggaattccagttgggatagttgccgttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactaccacttttcattttagctaattggagaggtttctcgggtggacaaagggatctctttgaagggatccttcaagccggatccaccattgtcgaaaatcttaggacttataatcaacccgtttttgtttatataccaatgatgggggagcttcgaggaggcgcatgggtggtcgtggatagtcgaattaattccgatcatatagaaatgtacgccgaccaaacagctaaaggaaatgtgcttgaacccgaaggaatgatcgagattaagttcagaaccaaggaacttctcgagtgtatgggaaggcttgatcaacaactcatcggtctcaaggaaaaactagcagaagccaagagctctaattcctacgataaaatcgaccccctgcagcaacaaataaaagcccgcgagaagcaactattgcctctatatactcagatagccaccaaatttgc

SEQ ID NO: 3 - DNA, 638 bp, Amaranthus graecizans
aaatatactccttcccgtgatcgtcaatggcatctttacacggttattgataaaccactcattcggaggatgtttttgagaacccttgtaagacaacccatctctgagttcacaggcgtcgaactaagcgctcttgaaacacaaaagcccatctcttttacttcaagaagcatcctaaggtccttaacaaccgccatggaggagttggaactcaatgcacatagtgcttcattgaaacccgatcacgctcatatgtacttgtacattgttcgagagcaacaaatatacgatcttgtgccatatcacagggaggtgaacatagattaccaacaagaagaggcttcggttcaattctttttggaagagctcgcgcatgaaatccacagtcttgctggtgtaaggatgcataaactaaatgtttgtgagtgggaagtgaaacttcggatatcttctcccgggaaagctaatggtttatggagggtggcggttactaatgtgactggtcagacctgttcggtacatgtttatcgtgaattggaagatagcaacctacatgaaatggtctaccattcattatccgttcacggtccccaccatggggtacctgtgaatgcaccctatcaaccactaggtggcat

SEQ ID NO: 4 - DNA, 2174 bp, Amaranthus hybridus
tgaacatagattaccaacaagaagaggcttcggttcaattctttttggaagatctcgcgcatgaaatccatagtcttgctggtgtaaggatgcataaactaaatgtttgtgagtgggaagtgaaacttcggatatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatctcccgtaagcgacttcaggccatgaagagtagcacaacatactgttacgattttccactggctttctcaactgccctgaagcaatcatgggcatcggaagctccggatgtcaagaaaccctcggacaaagcacttttgaaagtaaccgagctagcatttgctgatccaaaaggcacatggggaactccgcttgttccaataaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaaccccgagagtggatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcgggaggtttacagttcacacatgcaacttggtggaccgaagataatgggcacaaacggggtagttcatcttacagtttccgatgatcttgaaggcatttcatctatcttgaagtggctgagctatgttccaccctattcaggtggtgaacttccgatttctcggtgtttagaccctcccgaaagaccggttgcgtatttgcctgaaaattgttgtgatcctcgtggggctatatctggtacggttgactccgccggtaaatggtttgggggtattttcgacaaggatagttttgtggaaaccttagaaggatgggcacgaacagttgtcacgggaagggctaaactcggaggaattccagttggcatagttgctgttgagacacagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgaccaacaactcatcggtctcaaggaaaaactagccgaagccaagagctctaattcctacgataaaatcgagcccctgcagcaacaaataaaagcccgcgagaagcaactattgcctctttatactcagatagccaccaaatttgccgagttgcatgatacgtctttaaggatggctgccaaa

SEQ ID NO: 5 - DNA, 530 bp, Amaranthus hybridus
cactcgtcaagactgttcgagatgctgcaggtgaacggttgacccataagtcggctttggagttgatccggaaatggttcaatgagtcagatatttccggagaggcttccgatgcttgggctgatgatgcgaccttctttaagtggaaggacaataccgctaactacgaggagaagttgaaagagttgcgggttcagaaggtattggatcagctgtcgaatattggagattcggtaactaatttgagggctctgcctcagggtcttgctgccctacttcaaaaggtggatccatcgagtcgagaagaactagtcgaggaactccgaaaagtgctcacttgatttcgcaaccgttgatggtgaagtgaaaccttcttggtttcatcatggtagaaaatattattaggcaaatctataatttttagtgacatcaattgttttagacaatagtattgaactaatttatttaattaaattgtataaataggagaccttgaattcatttgaattaagtggcttatgcttgcatta

SEQ ID NO: 6 - DNA, 527 bp, Amaranthus hybridus
tatagatgaagtagtacagagtttgctggaatgccttgatagtcccgaacttccattccttcaatggcaagaatgcttgtctgtgctggcaacacgacttcccaaagatctgagatacgaattggaatcaaaatctagagcttttgaagggattaccaacacccagaacgtagaatttcctgctaagttgttgaaaagcattcttgaggaccatttaaactcatgccacgagaaagataaaggagctcaagagaggcttattgagcctcttatggctcttgtaaagtcttacgaaggtgggcgagaaagtcatgctcgttttattgttcaatctttatttgaagagtatttatccgttgaagaattgtttagcgacaatctccaggctgatgtgattgaacgtctccgccttcagtataagaaggatctgctgaagattgttgacattgtactgtcgcatcagggtgttaagaataaaaataagctgattctacgactcatggaacagctggtttacccaaatcccg

SEQ ID NO: 7 - DNA, 1310 bp, Amaranthus lividus
cgagagtggatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcgggaggtttacagttcacacatgcaacttggtggaccgaagataatgggcacaaacggggtagttcatcttacagtttccgatgatcttgaaggcatttcatctatcttgaagtggctgagctatgttccaccctattcaggtggtgaacttccgatttctcggtgtttagaccctcccgaaagaccggttgcgtatttgcctgaaaattgttgtgatcctcgtggggctatatctggtacggttgactcctccggtaaatggtttgggggtattttcgacaaggatagttttgtggaaaccttagaaggatgggcacgaacagttgtcacgggaagggctaaactcggaggaattccagttggcatagttgctgttgagacgcagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatatccctatgatgggggagcttcgaggaggcgcatgggtggtcgtcgatagtcgaattaattccgaccatatagaaatgtacgccgatcaaacagctaaaggaaatgtgcttgaaccggaaggaatgatcgagattaagttccgaaccaaggaacttctcgagtgtatgggaaggcttgaccaacaactcatcggtctcaaggaaaaactagccgtagccaagagctctaattcctacgataaaatcgagcccctgcagcaacaaataaaagcccgcgagaagcaactattgcctctttatactcagatag

SEQ ID NO: 8 - DNA, 1309 bp, Amaranthus lividus
aaagcattcttgaggaccatttaaattcatgccacgagaaagataaaggagctcaagagaggcttattgagcctcttatggctcttgtaaagtcttacgaaggtgggcgagaaagtcatgctcgttttattgttcaatctttatttgaagagtatttatccgttgaagaattgtttagcgacaatctccaggctgatgtgattgaacgtctccgtcttcagtataagaaggatctgctgaagattgttgacattgtactgtcgcatcagggtgttaagaataaaataagctgattctacgactcatggaacagctggtttacccaaatcccgctgcatacagggggaaacttatccgtttctctcaattgaaccatacaatgtattctgagttggcactaaaggccagtcaattgcttgaacaaacgaaattgagtgagctccgttcgaacattgctagaaacctctctgagctagaaatgtttaccgaggatggcgaaaacatggatactccaaaaagaaaaagtgctattaatgaacgtatggaggcgcttgtgagtactcctctagctgtcgaagatgcccttgttggtttgtttgatcatagtgatcatacacttcagaggcgggttgttgagacctatgttcggaggctttatcagccttatcttgtcaagggaagtgtcaggatgctgtggcacagatcaggcttcatagctttatgggaatttgttgaggagaatattgaccgaacaaatttttctgatctgactacaaacagtgggaaccatagtgagcgaaagtggggggccatggtcgttattaaaactcttcagttcttgccatcggtaattgctgcagcattgagagaaacaactcatagttccgatcaatcaacttccactggctctatagaatcagtcatccatggaaatatgctgcacattgcactagtgggggtgaataaccagatgagcttgttgcaggatagtggtgatgaagatcaggctcaagagagaatcgataagttggccaaaattctgagagaacaagaagtgagttcagcccttcgtgctgttggtgttggtgtgattagttgcatcatacagagagatgaagggcgaactccgatgaggcattcattctattggtcagcagaaaaacaatattatagtgaggaacctttactacgtcatttggaacccctctatctatgtatctcgagctggacaagcttaagggttatgaagatatcaaatatactccttcccgtgatcgtcaatggcatctttacacggttattgataaac

SEQ ID NO: 9 - DNA, 638 bp, Amaranthus lividus
ggcagttactaatgtgactggtcatacctgttcggtacatgtttatcgtgaattggaagatagcaacctacatgaaatggtctaccattcagtatctgttcacggcccccaccatggggtacctgtgaatgcaccctaccaaccactcggtggcatctcccgtaagcgacttcaggccatgaagagtagcacaacatactgttatgattttccactggctttctcaactgccctgaagcaatcatgggcatcggaagctccggatgtcaagaaaccctcggacaaagcacttttgaaagtaaccgagctagcatttgctgatccaaaaggcacatggggaactccgcttgttccaataaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcctcttattatctggctgccaattcaggagctcgacttggtgttgccgaagagctaaaatcctgctttaaagttggctggtcggatgagtc

SEQ ID NO: 10 - DNA, 4689 bp, Amaranthus palmeri
  unsure (1)..(4689): unsure at all n locations
cataatacattaagtccagtatctatacaagagattaaaccagctacaaaaaagctgatgagcacaagatacatcaaacaaaaaccagcagctgatagcagtatttcctttttcttaatggcaagaatgcttgtctgtgctggcaacacgactccccaaagatctgagatacgaattggaatcaaaatctagagcttttgaagcgattaccaacaccccaaacatagaatttcctgctaagttgttgaaaagtattcttgaggaccatttaaactcatgccaagagaaagataaaggagctcaagagaggcttattgagcctcttatggttcttgtaaagtcttacgaaggtgggcgagaaagtcatgctcgttttattgttcaatctttatttgaagagtatttatccgttgaagaattgtttagcgacaatctccaggctgatgtgattgaacgtctccgccttcagtataagaaggatctgctgaagattgttgacattgtactgtcgcatcagggtgttaagaataaaaataagctgattctacgactcatggaacagctggtttacccaaatcccgctgcatacagggggcaacttatccgtttctctcaattgaaccatacaatgtattctgagttggcactaaaggccagtcaattgcttgaacaaacgaaattgagtgagctccgttcgaacattgctagaaacctctctgagctagaaatgtttaccgaggatggcgaaaacatggatactccaaaaagaaaaagtgctattaatgaacgtatggaggcccttgtgagtactcctctagctgttgaagatgcccttgtcggtttgtttgatcatagtgatcatacacttcagaggcgggttgttgagacctatgttcggaggctttatcagccttatcttgtcaagggaagtgtcaggatgctgtggcacagatcaggtttcatagctttatgggaatttgttgaggagaatattgaccgaacaaatttttcngatgatctgactacaaacagtgggaaccatagtgagcgaaagtggggggccatggtcgttattaaaactcttcagttcttgccatcggtgattgctgcagcattgagagaaacaactcatagttccgatcaatcaacttccactggctctatagaatcagtcatccatggaaatatgctgcacattgcactagtgggggtgaacaaccagatgagcttgttgcaggatagtggtgatgaagatcaggctcaagagagaatcgataaattggccaaaattctgagagagcaagaagtgagttcagcccttcgtgctgctggtgttggtgtgattagttgcatcatacagagagatgaagggcgaactccgatgaggcattcattctattggtcagcagaaaaacaatattatagtgaggagcctttactacgtcatttggaaccccctctatctatgtatctcgagctggacaagcttaagggttatgaagatatcaaatatactccttcccgtgatcgtcaatggcatctttacacggttattgataaaccattcattcggaggatgtttttgagaacccttgtaagacaacccatctctgagttcacaggcgtcgaactaagcgctcttgaaacacaaaagcctatctctttcacttcaagaagcatcctaaggtccttaacaaccgccatggaggagttggagctcaatgcacatagtgcttcactgaaacccgatcacgctcatatgtacttgtacattgtccgagagcaacaaatatacgatcttgtgccatatcacagggaggtgaacatagatcaccaacaagaagaggcttcggttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatcgcccgtaagcgacttcaggccatgaaaagtagcacaacttactgttacgattttccactggctttctcaactgccctgaagcaatcatgggcatcggaagctccggatgtcaagaaaccctcggacaaagcgcttttgaaagtaaccgagcttagcatttgctgatccaaaaggcacatggggaactccgcttgttccaataaatcgcaagcctggtatgaacgatgttggcatggtagcctggtacatggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaatcccgagagtggatttcagtatgtctacttaacccctgaagattacgatcgtataggatcgtcagtcatagcccacgagttaaaactcgaaagtggagaaaaaagatgggttatagataccgttgtaggtaaggaggacggattaggtgttgagaacctatcgggaagtggtgctatagccagtgcatactcaagggcttacaaggaaacatttactctgacttttgtaaccggaagaacggtcggtattggtgcctatcttgctcgtcttgggatgcgttgtatacagaggcttgaccagcctataattctcacgggtttttctgctttaaataaacttctcggccgggaggtttatagttcacacatgcaacttggtggaccgaagattatgggcacaaacggggtagttcatcttacagtttccgatgatcttgaaggcatttcatctatcttgaagtggctgagctacgttccaccctattcaggtggtgaacttccgatttctcggtgtttagaccctccagaaagaccggttgcgtatttgcctgaaaattcttgtgatcctcgtggtgctatatctggtacggttgactccaccggtaaatggttagggggtattttcgacaaagatagttttgtggaaaccttagaaggatgggcgcgaacagttgtcacgggaagggctaagctcggaggaattccagttggcatagttgccgttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggccggatccaccatagttgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgatcaacaactcatcggtctcaaggaaaaactagccgaagccaagagctctaattcctacaataaaatcgagcccctgcagcaacaaataaaagcccgcgagaagcaactattgcctctatatactcaaatagccaccaaatttgccgagttgcacgatacgtctttaaggatggctgccaaaggagttattagggacgtcttggaatggaaaagctcgcgttcgttcttttacaaaagattatacaggagagttatggaggaatcactcgtcaagactgttcgagatgctgcaggtgaacggttgacccataagtcggctttggagttgatccaaaaatggttcaatgagtcgaatatctccggagaggcttccgatgcttgggctgatgatgcggccttctttaagtggaaggacgataccgccaactacgaggagaagttgaaagagttgcgcgttcagaaggtattggatcagctgtcgaatattggagattcggcaactaatttgagggctctgcctcagggtcttgctgccctacttcaaaaggtggatccatcgagtcgagaagaactagtcgaggaactccgtagagtgctcacttgatttcgcaaccgttgatggtgaagtgaaaccttcttggtttcatcatggtagaaaatattattaggcaaatctataattctagttacatccattgttttagacaatagtattgaactaatttatttaattaaattgtataaataggagaccttgaattcatttgaattaagtggcttatgcttgcattattttgtattgaatcaaataattatttacatacttttgattattaataatggtaaatcctcaaaatttgagggatttgttacct

SEQ ID NO: 11 - DNA, 1582 bp, Amaranthus palmeri
gttgcagcattgcatagccgtgattgcagtgtccaaaggcggcaccaaaagatcattgaagaaggcccaataacgatagctccaccagaaacggtgaagaagcttgagcaagcagctagaagattggctttatgtgtgggttatgttggcgcagctacagttgaatatttatacagcatggaaacaggcgagttccatttccttgagttgaatcctcggttacaggtggagcatcctgttactgagtggattgctgaggtaaatcttccagctgctcaagttgcagttggcatgggtatcccactttggcaaattcctgaaatccgtcggttctatgggaaggaacatggtgggggttatgatacttggatgaggacatctgctttggctactgcttttgattttaacgaggcacagtcggtgaaacctaaaggtcattgtattgctgcgcgtgtgacaagtgaggatcccgatgacggttttaagcctacaagcgggaaagtacaggagctgagttttaaaagtaaaccgaatgtgtgggcctacttctctgttaagtctgggggaggcattcatgagttctcggattctcaatttggccatgtttttgcatttggtgaaaaccgaggtttggccatagcaaatatgattcttggattaaaagaaattcaaattcgtggagaaattcgaactaatgttgattacaccatcgatcttttaaattgtttggattatagagaaaaccaaattcatacaggttggttggatagtagaattgcgatgagggtcagagctgaaaggccaccttggtacatctctgttgtgggaggagggctttacaaagcatcgactagtagtgcagcgactgtttcagagtatataggctatcttgaaaaaggtcaaattcctccgaagcatatatcactcgtccactatgaagttgctctaaatatcgaggggatgaaatataccattgagatgattaggggtggaccaggaagctacaaaatgtggttgaatgggtccgtagttgaggcggaaatacatactttaagagatgggggtctcttgatgcagttggacggaaacagccatgtgatatatgccgaggaagaagctgcaggaactcgccttctgattgatggaagaacttgtttgcttcagaacgatcacgatccttcaaagctaattgcggagactccgtgtaagcttatgcggtatttggtaccagataacagtcacatagatgcagatactccgtatgctgaagttgaggtcatgaagatgtgtatgcctttgctttcccctgcatccggtgttttacaatttaagatgtccgaaggtcaagctatgcaggctggtgaactcatagctagtctagagttggatgatccttcagctgtaagaaaagccgaacctttcagtggaagctttcctgtcatgggctcaccaactgcaatatctggaaaagttcatcagaggtgtgccgcaagtttaaatgccgctcggatgattttggctggttatgaacacaatatagatgaagtagtacagagtttgctggaatgccttgatagtcccg

SEQ ID NO: 12 - DNA, 822 bp, Amaranthus palmeri
agatgtgtataagagacagtataatcaagttttttagtacccaaagctctaaatgttacttaaagttttgatcttttaatggtttcttctatttaatccaataatttaaagtacccagatttcaatttttagaataaattgagtttttgaattgcccaagttgtaattgttgctgaattctcttgctttgatttgggttttctgattctatcccttctgattcatacagtttcaggagcagtggtctcattttcgagcaatacaaaaagtgccgtgcttctctaaacaacgacgattcagacatgtcttctccttcccacaataatgaaaacccgaacggaccgatgatgccactcctgaggaattcatctgtagtatccattgttgataagttctgttatgctcttggagggacgcggccaatccatagtattttgatagcaaacaatgggatggctgctgtcaaatttataagaagtatccgaacatgggcttacgagacttttggtactgagaaggctatattattggtagccatggctactcccgaagacatgaaaatcaatgccgagcatattcgaatggctgatcagtttgttgaagtccccggaggaactaacaacaataactacgccaatgtgcagctcattgttgagttagcggaagttacacgagttgacgcagtttggcctggttggggacatgcatcggagatccccgagttgccagattcattagctacgaagggaattgtgtttctgggccccccagctgcatctatggctgctcttggagataaaattggttcatcattgattgcac

SEQ ID NO: 13 - DNA, 17981 bp, Amaranthus palmeri
aaaccaaaccaacctccttaaacttctcttcttctactcaccattttttcctctttttattgattattgattttaaatatacattatattgtaggaatttaatgaaattttcattaaattctgataaagttttgattttttttagtgtatgagatttttcagaagtacccaaatggtaaatttcaagtataatcaagttttttagtacccaaagctctaaatgttacttaaagttttgatcttttaatggtttcttgtatttaatccaataatttaaagtacccagatttcaatttttagaataaattgagtttttgaattgcccaagttgtaattgttgctgaattctcttgctttgatttgggttttctgattctatcccttctgattcatacaggtattctgattttttcttgcttgattactttttgttagtgtatggttgagctaatttagtttatagtagtgtgaattttattttattttttttcaattttttcaattatttcaatttgtagagtagattctcctattatgatttgtttttgtagctgggttttaatttttattgtctgatgatttatcttagcaatgttttaatgggtgtgctgtttttcaatttatagtgtaatttagttgattcctcttttccaatagagtgtacaaaaccgacctgattaactgaaaccgagtattatccaacgggaacaatccctgttacaaaattcaaattagaatgtcaagtaccgaaatcaacccgaccccacatattatacccgagatccacccgaacacccgaatgaacacctctgagatcatagagaggatataaagaaaagtggaactagaatggggaatttagtttatttgagctacattgagcaaaattttttttagtgactgattattgtagctggcttttgttgtataactcatctaagcaatgtttttgatgtgtgtgcagtagcattggattgttttgattttttgttatattgtctatacaattcaaatcttgaatcacacttgacttttagttccattttcatcttcacaaattcttgtgagagactgtcaactgtgagacgctctctgtacatgggctaaatagcgtaactaatacaactattagcatatgagcttcttattttgaggtcgtctctcataagagtagctctctgttcttttatgatttatgattcaatgcaaataaattatttacggcccgtgtggtaggtggtaataaacaatagtaatgagaatgaaaaacaagtgtaattttggttaaaaaatctcttggttacgttgatggtcatgcttgtccaacttaaatcatctcacactatcattgggagaggtggtgttaggtggtaatgaaaatttgtaaacaaaaaaacttgtttgtgatcaaagtttcattaccataggaacgatacggaacttttgatgaaattttacactataaatcatttccattaccaccatttagtacctctaaccaaacgggacgttagagttttgcttacctacaatatcttcttagctcataagctcagaaccttacttcaattttgaccatatgtttctagctatactttcagtaagtatttaaaaattcattttcattttatctatgtatagttgcgaatgatgtttgttataaagggtcaatcgaaaaacttcctctttgttattagtaacaagggtaaggttatgtacatccaatccctccaaaccctttttgggtgggagctactaatggcgctgggacaatggagttgttgtttgtcgaattcaagcggggaagtttgtttagaatgaatgttatttctaaaaatagatggtataagtatgttaatcaacaattaataatagagaactgttttattggtgtgataaacagtttcaggagcagtggtctcattttcgagcaatacaaaaagtgccgtgcttctctaaacaacgacgattcagacatgacttctccttcccacaataatgaaaacccgaacggaccgatgatgccactcctgaggaattcatctgtagtatccattgttgataagttctgttatgctcttggagggacgcggccaatccatagtattttgatagcaaacaatgggatggctgctgtcaaatttataagaagtatccgaacatgggcttacgagacttttggtactgagaaggctatattattggtagccatggctactcccgaagacatgaaaatcaatgccgagcatattcgaatggctgatcagtttgttgaagtccccggaggaactaacaataataactacgccaatgtgcagctcattgttgaggtaatgtatcgtgagattagaaatttctagcctgtaatccatagttacatggaatgtggaacatagccacgttccgcgattcgggaacattcaatcccaatcaccatgaaacccgacctaaatcactaaaggtgacgtcccggtgtagaacaccttttttttaaaatgtatttttggccttcatttacaaattaaaggaaaaagaaaggaggaaaaaacaagatgtaacccagaaacctaaacaaatccacttgaaaataatttcttaaagcaaattaatcattttagtttaattttgtttcaaatatatatattatacataatgtgtctcatacccaatcgttcttgagtaaatctaggttgcgttctgtgttcccattcttgtttcccgttcgaaaccaaatgtcgttcagttaacaatgctgttatctgctttactgtgatttattaaatgtgtcctttgaaaaaaaggcaatatcagagcgactcgacgcagtttggcctggccggggacatgcgtaatatgtaatatgagattacaaatttataaccttttatatggtaaaatcttgtggtaggactaacttaaatcctttttctttcagttagcggaagttacacgagttgacgcagtttggcctggttggggacatgcatcggagatccccgagctgccagattcattagctacgaagggaattgtgtttctggggcccccagctgcatctatggctgctcttggagataaaattggttcatcattgattgcacaagctgcagatgtcccaactcttccatggagtggttctcatgtacgtactacacgttttttttttcttttttttttccttccaaatttctgatctttagagttttagtgatagatttatatacgtctctatccctcaggtgaaaattcctgctgagagttgcctagacgtaattcccgatgaagtatataaagcggcatgtgtttttactacagaggaagcaattgctagctgtcaagttgttggttatccggctatgatcaaagcttcttggggtggtggagggaagggaataagaaaggtaaaatttttttggatgatgatgctcttaaaagactaaaaggaggttacacatatccccattacttgtttatcatcagaagcagagcaaaaattgacaaagatttaaagactctgtgcaatttcaaaaatatgatatatttctaacaacgtatcttcaaacactttaaacatactacctattttaatactgcggcccctatttttttgaggccgtgtgtggtcgaacatattgaatatgcttagaaccactcctgtttatcactaatatgccatcttccacagtcgaacctctactttgacccagattccttgaaagggatttcgatttagactcgagctatggtcaattattagcaatagcaaaagcttcttaatagttaatagattctcaaacacttccgtcatgccaacactttatgaagactcatgggtattctctcttttaggttcataatgatgacgaagtacgggcattatttaagcaagtgcagggtgaagttcccggctcacccatatttataatgaaggtggcttcacaggttagactttcttcaacattggtccgatattcgagtaaattgcattaaaaaaggttaaatatacaatttttttggataagtattgtatgagagactactactaagataaagtattattaatatgtgcagagtcgacacttagaagtacagttactgtgtgatgaatatggcaatgttgcagcattgcatagccgtgattgcagtgtccaaaggcggcaccaaaaggtgggtctttggtagattatggttatgatctacggtttgttattgtttaagaaaaatatttgattttaagcattatttagcttgctgggatttgaacttttctgttcatcattttaactaatcagatcattgaagaaggcccaataacaatagctccaccagaaacggtgaagaagcttgagcaagcagctagaagattggctttatgtgtgggttatgttggcgcagctacagttgaatatttatacagcatggaaacaggcgagttccatttccttgagttgaatcctcggttacaggtatggagcttccccaacttcttttaagtacccattatgtaactgcatatttatgtaatccctccattccaaattagtcgctatgtattcctatggggatgtcccaaattagttgcaacatttctgtatatggtaaagttttcccctccaaaccttaaaacctagttgaccataatctaactaaacccaattcttgacccactttgaaaaacaggtcaaatgttggtgtttgaaccacctttaaacaaatttaagattttgggttggtaatggcttatcagagatttgggtttttggcatcggcattattttggtgtcgatttgcaaatgatatcccgggatttcgaactaggaggggattcaattggtttttgaggaatttatgtaattattcctttaattagtgatcattgaattgattgtatttgtgttggggaattggacccgtgaagaaaaaaatgacgggttagcttttggattagtgagtgattatgtgagtttaatttgtctatgaaaggtcaacttcaagcaacattttctgttttagcttagtaatttttgggatgcgatggaacatttgagcaccttctggattatcaacagaaatgatcatcgaaattgatttttttagttgttgacagtagaaaagtatcagataaggtagaataatacagtataatctttagttgcgacaatttccaacgtttttataatagctaaagctacattctcatgttgcttgatgaaagtgaccgtatttattctgtgtgcttatacaggtggagcatcctgttactgagtggattgccgaggtaaatcttccagctgctcaagttgcagttggcatgggtatcccactttggcaaattcctggtaaatgtccagtactcttttttcggttatgtaacttatatattatatctaattcttatttacgaaccgaattgatcacacatttttaaaacagaaatccgtcggttctatgggaaggaacatggtgggggttatgatacttggatgaggacatctgctttggctactgcttttgattttaacgaggcacagtcggtgaaacctaaaggtcattgtattgctgcgcgtgtgacaagtgaggatcccgatgacggttttaagcctacaagcgggaaagtacaggttagaccatcctggttttgtcgatttacttccacaattggtcttgttttgtttttgcctttgcggtgaagaattttctttaatgggtgctttgtttaggagctgagttttaaaagtaaaccgaatgtgtgggcctacttctctgttaaggtattttccatatttctttaattctttgattttcgcgtttacaatttcagttcactccattatgggcttgatgatgataaacacttttatttgcagtctgggggaggcattcatgagttctcggattctcaatttggtaagttaatggtgcaaactcttgtcagtaatgttaactacagtttcacatgatttactaatctcttcgtgaattgcgaactaaaaaagagaattattgtcagttttgggctattttttattccattttgagccaatggaaattcaaaaagcgaatagctagcgaattttgttgatattctggaggtgtatattgatgagaattttacaaaaagttgctgctgctgcactgtgttattttttagaaacactgggtgactttcaattgtttgtaaaacttgcatattcgagtcacaacatgatgtcataatgaaatgcgagcggtttttattaaataatagagccatagtgtaatcgaccaatatttaggtggtgcaatgaccgcatcactcccgttaccgcattaccgttccctaccgcgatcacgatcgttagcgcatttttacgctatgaatagaccttcagttcatattttatgatggctaaaatcaatcacttggttaatggtatatcatatacgaaggctaacaaaagaatttctttacaggccatgtttttgcatttggtgaaaaccgaggtttggccatagcaaatatgattcttggattaaaagaaattcaaattcgtggagaaattcgaactaatgttgattacaccatcgatcttttaaatgtgagtttgaatgtaatttttgttgtctttttttagttttcgcctttcttctgttaaacctttgaagttctcacacttaacttttttttcctccagtgtttggattatagagaaaaccaaattcatacaggttggttggatagtagaattgcgatgagggttagagccgaaaggccaccttggtacatctctgttgtgggaggagggctttacgtatgtacaactttttcatagctatcattaatttttccgttgttatgatctgtgttacttggactcgggttgttggatactggtatgtgtccacgtgtcggatacgtctaaatattcaattttacgcctaaaatgaagtatctaagtgccatgtccgagcatcaagaatcggacacgggtacgtgaagccaaatgaagagtccgagtaacataagttatgattaatgttaaataacttgttttctttatcctctatatccagaaagcatcgactagtagtgcagcgactgtttcagagtatataggctatcttgaaaaaggtcaaattcctccgaaggtatgtaacatacaattggttggcgggtgtttagattaacttattctattaatatcaattatactttcagtgttctgctttaattctggtttcatgattgcagcatatatcactcgtccactatgaagttgctctaaatatcgaggggatgaaatataccgtatgttccatgccattcgtactttcctcgtgaatttttgttatggatgctatttttgacattttctttctaaatatattttcttgaaattaatgaacatgtcgtttcggattgccagattgagatgattaggggtggaccaggaagctacaaaatgtggttgaatgggtccgtagttgaggcggaaatacatactttaagagatgggggtctcttgatgcaggtatcaaatgttttttgatatttttttttctgatatacggtatttatattttatatccaaagcatggtgataataccctggatttgtaaagcattagataatatgttatcaaacaagtagaaggtagtttcgtgaaaccatgaagcgtttagtttagatttgaattttaatacttctacaatgcttgggatattaatcaataatcatgcttctaatagtaaagagaaatattgtcatagactcataggtataatggctcgttaaatcatatgcacttcttgtttatgtgaagtccgagttggtgtttgcaatcaacgtttgaaatcaagggcatagtgcaaaatctcgaatgtggtcacttttgtggtcaatgtagatggtttcatttctatcgtggtataaatatgggtcgcagtaatcttaagaacctatatagtagacgataacttgttattaaaagggtaaaggctgcatacatccgatgtcccatttacccggtctagatgtgagctacttggggtttttgttattgaagttaaagatacaagaaggattattgctaaaaaaaaaaaagaatatttgaactacaaaaaaagtaattagtttatgtactagttcgttctagcccatataactcatttaaaaaaatatatgaaaaagggctttcaatgtcatgaacggaagggaggaaatggactgtggaagagtcaacaaagattacatatgaattctcttttgttgtttaaaaaactttgaaattgaaaattgttggctttttgttgaagaaacgatgtgtgtcagttgaaaacagaatatttaaactacaaaaaaagcaattagtatatacacaatacacttgttcatttaaacccatatagtacatttaaataattatttgaaaagggctgttaatgtgtgaagactttcgctatattgatctgattggatatgtgtaataccttgaaacgtcatgcagttggacggaaacagccatgtgatatatgccgaggaagaagctgcaggaactcgccttctgattgatggaagaacttgtttgcttcaggtaatgccgtgtgattctcttttttttttttttttgtgaattctaaaccttaaaaatcattcttcaccggacatgttcatttttccatatagaacgatcacgatccttcaaagctgattgcggagactccgtgtaagcttatgcggtatttggtaccagataacagtcacatagatgcagatactccgtatgctgaagttgaggtcatgaagatgtgtatgcctttgctttccccagcatccggtgttttacaatttaagatgtccgaaggtcaagctatgcaggtatgcatcattttaatcgtaaattcagcaacctcgtttatattggattctatatatggtcttgctgtgtaggctggtgaactcatagctagtctagagttggatgatccttcagctgtaagaaaagccgaacctttcagtggaagctttcctgccatgggctctccaactgcaatatctggaaaagttcatcagaggtgtgccgcaagtttaaatgccgctcggatgattttggctggttatgaacacaatatagatgaagtaagtttcaaaccaccatttcatttttcatcaacatagtttttaggctagcctcttaatgggttgatgccatagtgtaaaaacaaggccacatcgcatcacgtcaccgcgttgttaaggatttcaaaaacaacgaaccgatatttcccatgttgtgggccgtaccaagggatatcttatggttttgaccggtatttaggcgttacaataaccgcatcactcccgttaccgcatcattgttctgttacactatggatgccgaaccttgagatgcatttcccatttttcaatagagcccctagtttttttcttcctgtttggaaattttttacatgtgagccttttattttctcaggtagtacagagtttgctggaatgccttgatagtcccgaacttccattccttcaatggcaagaatgcttgtctgtgctggcaacacgactccccaaagatctgagatacgaagtgtgtattctatcatctgttctttatttagttatttatatttccttataataattttgaactttttcctcggagtttacagttggaatcaaaatctagagcttttgaagcgattaccaacaccccaaacgtagaatttcctgctaagttgttgaaaagtattcttgaggttagtacctcactttgttaccttctgtaaattattcattcggcgagttactcatgttagtaacatgtttattcttcgtaggaccatttaaactcatgccaagagaaagataaaggagctcaagagaggcttattgagcctcttatggttcttgtaaagtcttacgaaggtgggagagaaagtcatgctcgttttattgttcaatctttatttgaagagtatttgtccgttgaagaattgtttagcgacaatctccaggtttgtccatctatctagagcaatttgattatgatgtttttttaaagttcataaattttagcttggtgccacaccgtcagtggctgatgatcgtcgctttgtgatcattaagcttttaaaagctgtctcctgttctccatcactatttttagaaattttgagttctgatgtatatactcggtacccgagggactctttggccgctttcttctttatgggtatgagttgcctccttccttccctccccagatcctgatcatagtttctatgagcgggatacattgggtatgatgatgatgatgtatatactcggtgctgagccagcatatgaaaagcaaactgtcgtgaatttatcttatgtctttaaagaataccgaggcacctgattttacattttatctttatttttttctgtatgaagaaatagtaaattatattcttcaatagttgactcggagtgatgtttgtaatatgtttagaaaaaatgttggactagaaagtcagcgcagcgcatatattagtttatgattgtggctttaatcagtttatgcttttgatgttaatctttccaggctgatgtgattgaacgtctccgccttcagtataagaaggatctgctgaagattgttgacattgtactgtcgcatcaggtacgtattcttgatttactgttgttccttttgttctcttcggcatttctatttttttttaatatattttatggttttcagggtgttaagaataaaaataagctgattctacgactcatggaacagctggtttacccaaatcccgctgcatacagggggcaacttatccgtttctctcaattgaaccatacaatgtattctgaggttggtgatcctcaaacacccaaagctatgtatttctcataatgcttaagtagagtaataattaataattgtccaatgattgcagttggcactaaaggccagtcaattgcttgaacaaacgaaattgagtgagctccgttcgaacattgctagaaacctctctgagctagaaatgtttaccgaggatggtgaaaacatggatactccaaaaagaaaaagtgctattaatgaacgtatggaggcccttgtgagtactcctctagctgttgaagatgcccttgttggtttgtttgatcatagtgatcatacacttcagaggcgggttgttgagacctatgttcggaggctttatcaggtgaatacatactttaaatgcggactcggtcctattcattgtagaaacttctcttgatctttctcgagtcgggggactctttggccgcactctcctttatgggtatgagttgccgccttccttccctccccagaccctgcacatagtttttctatgggaaggatactctgggtatgatgatgatgattattattatcgctacttgaacaatttttcttatgttatttaactccttttttgtttttggcaaccgctttctcagccttatcttgtcaagggaagtgtcaggatgctgtggcacagatcaggtttcatagctttatgggaatttgttgaggagaatattgaccgaacaaatttttctgatgatctgactacaaacagtgggaaccatagtgagcgaaagtggggggccatggtcgttattaaaactcttcagttcttgccatcggtgattgctgcagcattgagagaaacaactcatagttccgatcaatcaacttccactggctctatagaatcagtcatccatggaaatatgctgcacattgcactagtgggggtgaacaaccagatgagcttgttgcaggataggtaaataagactagcctgtaacatatggtgtaataatctttattatgtaaccttgtgcttctaatgtcctttagttctatggactatattaaagtacacttcttgttcatgtgatgttgatgttgataattgctatcgggtcaatcacaaacaacctctttgttatcacttgaggtgttcaaaatagacccgatgactcgatattcatcagatcttgtaactgaactcgacttcaaaatgaatttaaaattatataaaaatcaatatggacacaagaccggatatcaatccgacccgaaatagttgactcgaaatcaacttgatgatccgaatgaacacctctagttatcactaacaagggtcagattgcgtacatcaaacccctcaaatcctgcttaggtgggagcttgtcaatggcttaggggtaacgggaatgtgtgtgctatgtacattgtgcatctattcttatacttatgttgagttttttggatcaaatataaagaacttaacttttgtattttcttgatgtggtgtagtggtgatgaagatcaggctcaagagagaatccataaattggccaaaattctgagagagcaagaagtgagttcagcccttcgtgctgctggtgttggtgtgattagttgcatcatacagagagatgaagggcgaactccgatgaggcattcattctattggtcagcagaaaaacaatattatagtgaggagcctttactacgtcatttggaaccccctctatctatgtatctcgagctggtactagtctctgaaccgattgcctttcttctgctttgttattctgtgtgatatttcgacttaagtctaatttacatcgttttgtacatttgttatccaaagcacgttaaaagatacttccttcgtttttttacaagcacccaaacacctttttacgcagcccaattggtttgtcgggttgcttatatatagaattatactcaacttaaaaattataaaatttgatattatgaaagtattcgacgtgacgaattaaacaaaatcccatatgactatgtttttttctcgtttaatagctgtaatatgtaaaatactatcgaatgatgaatagtgtaaaaactggtttgggtgcaactaaaaaaatggaggaagtataattatgcagccaaaattgatggcttttaacttttcatcaaatcaggacaagcttaagggttatgaagatatcaaatatactccttcccgtgatcgtcaatggcatctttacacagttattgataaaccattcattcggaggatgtttttgagaacccttgtaagacaacccatctctgagttcacaggcgtcgaactaagcgctcttgaaacacaaaagcctatctcttttacttcaagaagcatcctaaggtccttaacaaccgccatggaggagttggagctcaatgcacatagtgcttcactgaaacccgatcacgctcatatgtacttgtacattgttcgagagcaacaaatatacgatcttgtgccatatcacaggtatctattgctgcgtgcctcatttttttttttgtttattattggtcattagtacaccttattcttagaagaaacttttttcggccaattatttccagggaggtgaacatagatcaccaacaagaagaggcttcggttcaattctttttggaagatctcgcgcatgaaatccatagtcttgctggtgtaaggatgcataaactaaatgtttgtgagtgggaagtgaaacttcgggtatcttctcccgggaaagctaatggtttatggagggtggcagttactaatgtgactggtcatacctgttcggtacatgtaagtcataagtttgagaacctcttttttgatctagtcacaattttgatttttcacaaattcttgtatgagacggtctcaccgtgagaatcaccccatacttggattaaatagccgaataatagaaacttttagcataatggaccttttgtatgaactcgtctcacggagagaaggtctcatacaataggggcaattaatttttagctttttatcggtaaattttgcatagtacatagttttgaattttgagaggttgagtctatgtgacaacgaatatttaattgagtataatgttgtttaatccaaatatgatataaaagggtgtggcatatgtgattgagcattcttttttcttttctatgggaagttaaaggtctaaaccttggtataatttccttcaatgatgagcaatcaaagggtttcagacctgtttatttatgactcgaaagtcgaacccaaaccagaacccgaacccgactcaacttgatttttttgacatgcctaaatggaactacagatgtattggggaaaataattaaactagaaaatggggaaaataattaaactagaaaatggggaaaacaatttacctagaatatgttttcagccaaaacaaacactcccaaatacatttcttagcatccacaaatgccgaggaattgcaatggaactccagttcctcggttcttcaacgtagagacgtatataattcttttttgcacgatatcattaaggttaattgacctgttttttctatgaaatataatttaatttttatgctctttagtttgttttactacacatgaatagttttggttttgagtgatcattttcttacattattgatgcccaggtttatcgtgaattggaagatagcaaccttcatgaaatggtctaccattcagtatctgttcacggcccccaccatggggtacctgtgaatgcaccctatcaaccactcggtggcatcgcccgtaagcgacttcaggccatgaaaagtagcacaacttactgttacgattttccactggtacggaatttgaaaatttcatcactccctcccccgtcttccccttaatatactttgtcgcccgttatttcatattccgttttatcaaccatgcaaggatcttccagggttccgaatttcattttttcgtacttccaaagtttcaggcaaacttactttttttgacgctgttgttttcaggctttctcaactgccctgaagcaatcatgggcatcggaagctccggatgtcaagaaaccctcggacaaagcgcttttgaaagtaacggagttagcgtttgctgatccaaaaggcacatggggaactccgcttgttccaataaatcgcaagcctggtatgaacgatgttggcatggtagcctggtacatggaaatgtccacccccgagttccctaatggaagaacaataatggttgtagctaatgatgttaccttcaaggccggatcttttggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaatcccgagagtggatttcagtatgtctacttaacccctgaagattacgatcgtataggatcgtcagtcatagcccacgagttaaaactcgaaagtggagaaaaaagatgggttatagataccgttgtaggtaaggaggacggattaggtgttgagaacctatcgggaagtggtgctatagccagtgcatactcaagggcttacaaggaaacatttactctgacttttgtaaccggaagaacggtcggtattggtgcctatcttgctcgtcttgggatgcgttgtatacagaggcttgaccagcctataattctcacgggtttttctgcgttaaataaacttctcggtcgggaggtttatagttcacacatgcaacttggtggaccgaagattatgggcacaaacggggtagttcatcttacagtatccgatgatcttgaaggcatttcatctatcttgaagtggctgagctacgttccaccctattcaggtggtgaacttccgatttctcggtgtttagaccctccaggaagaccggttgcgtatttgcctgaaaattcttgtgatcctcgtggtgctatatctggtacggttgactccaccggtaaatggtttgggggtattttcgacaaggatagttttgtggaaaccttagaaggatgggcacaaacagttgtcacgggaagggctaaactcggaggaattccagttggcatagttgccgttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactcccacttttcattctagctaattggagaggtttctcgggtggacaaagggatctctttgaagggatccttcaggccggatccaccatagttgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgattgagattaagttccgaaccaaggaacttctcgagtgtatgggaaggcttgatcaacaactcatcggtctcaaggaaaaactagccgaagccaagagctctaattcctacaataaaatcgagcccctgcagcaacaaataaaagcccgtgagaagcaactattgcctctatatactcaaatagccaccaaatttgccgagttgcacgatacgtctttaaggatggctgccaaaggagtcattagggacgtcttggaatggaaaagctcgcgttcgttcttttacaaaagattatacaggagagttatggaggaatcactcgtcaagactgttcgagatgctgcaggtgaacggttgacccataagtcggctttggagttgatccaaaaatggttcaatgagtcgaatatttccggagaggcttccgatgcttgggctgatgatgcggccttctttaagtggaaggacaataccgccaactacgaggagaagttgaaagagttgcgcgttcagaaggtattggatcagctgtcgaatattggagattcggcaactaatttgagggctctgcctcagggtcttgctgccctacttcaaaaggtaatctgatttattttatgtacattctttgttctttctcgtttgggttggatgtcgcttttgtaacgggtcgggtcggatcaatattttaatgggccgggtcaagtcatgtcaaattaaattgggcttatgggctttttgttttgaggttgtctcaccgtgagacggtctcatacaagacgggcagaaatctaaaacaaaaagtggtaaaaggccctttaatgttctgacctgttattgacctgacccaccgatgacccattaaaatgtaaccagactcttgacccgtcgggtcaacccaccctgttaaactccttattctaattgcacacaaaatctttgggagatgttttgatatcacacctcaaaaaaactcggaaaaactcctattaattcctacgataaacatacatcctcgatgccatgtatatttttcgatatctacttgtttttctattgacattttgctacggagaagtgacgttttagattgaacgcaggtggatccatcgagtcgagaagaactagtcgaggaactccgaaaagtgctcacttgatttcgcaaccgttgatggtcaagtgaaaccttcttggtttcatcatggtagaaaatattattaggcaaatctataattctagttacatccattgttttagacaatagtattgaactaatttatttaattaaattgtataaataggagaccttgaattcatttgaattaagtggcttatgcttgcattattttgtattgaatcaaataattatttacatacttttgattattaataatggtaaatcctcaaaatttgagggatttgttcctacaatgaaatcaaggacaaaatgtatagtttgagggaatggtgcttgtacacttgtctaaacaataacaggtgctctcttgagagaccgtcttatgtaaagacgactctcaaaagttcagcccaaatcta

SEQ ID NO: 14 - DNA, 9312 bp, Amaranthus palmeri
  unsure (1)..(9312): unsure at all n locations
atagctccaccagaaacggtgaagaagcttgagcaagcagctagaagattggctttatgtgtgggttatgttggcgcagctacagttgaatatttatacagcatggaaacaggcgagttccatttccttgagttgaatcctcggttacaggtatggagcttccccaacttcttttaagtacccattatgtaactgcatatttatgtaatccctccattccaaattagtcgctatgtattcctatggggatgtcccaaattagttgcaacgtttctgtaatatggtaaagttttcccctccaaaccttaaaacctagttgaccataatctaactaaacccaattctcgacccactttgaaaaacaggtcaaatgttggtgtttgaaccacctttgaagaaatttaagattttgggttggtaatgcttattagagatttgggtttgtggcatcggcattattttggtgtcgatttgcaaatgatatcccgggatttcgaactaggaggggattcaattggtttttgaggaatttatgtaattattcctttaattagtgatcattgaattgattgtatttgtgttggggaattggacccgtgaagaaaaaaatgacgggttagcttttggattagtgagtgattatgtgagtttaatttgtctatgaatggtcaatttcaagcaacattttctgttttagcttagtaatttttgggatgcgattgaacatttgagcaccttctggattattaacagaaatgatcatcgaaattgatttttttagttgttgacagtagaatagtaacagataaggtagaataatacagtataatctttagttgcgacaatttccaacgtttttataatagctaaagctacattctcatgttgcttgatgaaagtgactgtatttattccgtgtgcttatacaggtggagcatcctgttactgagtggattgccgaggtaaatcttccagctgctcaagttgcagttggcatgggtatcccactttggcaaattcctggtaaatgtccagtactcttttttcggttatgtaacttatatattatatctaattcttatttacgaaccgaattgatcacacatttttaaaacagaaatccgtcggttctatgggaaggaacatggtgggggttatgatacttggatgaggacatctgctttggctactgcttttgattttaacgaggcacagtcggtgaaacctaaaggtcattgtattgctgcgcgtgtgacaagtgaggatcccgatgacggttttaagcctacaagcgggaaagtacaggttagaccatcctggttttgtcgatttacttccacaattggtcttgtttttattttgcctttgcggcgaagaattttctttaatgggtgctttgtttaggagctgagttttaaaagtaaaccgaatgtgtgggcctacttctctgttaaggtattttccatatttctttaattctttgattttcgcgttaacaatttcagttcactccattatgggtttgatgatgataaacacttttatttgcagtctgggggaggcattcatgagttctcggattctcaatttggtaagttaatggtgcaaactcttgtcagtaatgttaactccagtttcacatgatttgctagtctttttgtgatttgcgaatcaaaaaagagaattattgtcggttttgggctattttttattccatttggagccaatggacattcaaaaagcaaatagctagcgaattttgttgatattctggaggtgtatattgatgagaattttacaataaattgctgctgctgcactgtgctatattttggaaacactgaatgactttcaattgtttgtaaagtttgcatattcgagtcacaacatgatgtcataatgaaatgcgagcggtttttattaaataatagagccgtagtgtaaaaacaaggccgcattgcatcgtgttggctgcattgtaaaggttttcaaaaacaatgaactgatatttcccacgttgtaaaggcataaaacattgcgtttagggaaatatcaaagaatatcttaaggtttcaaccgatatttaggtggtgcaatgaccgcattactcccgttaccgcattaccgttccttgctgcgatcacgatcgttaccgcatttttacactatgaatagaccttcagttcatattttatgatggctaaaatcaattacttggttaaaggtatatacgaaggctaacaaaagcatttctttacaggccatgtttttgcatttggtgaaaaccgaggtttggccatagcaaatatgattcttggattaaaagaaattcaaattcgtggagaaattcgaactaatgttgattacaccatcgatcttttaaatgtgagtttgaatgtaattcttgttgtctttttttagttttcgcctttcttctgttaaacctttgaagttctcacacttaacttttttttcctccagtgtttggattatagagaaaaccaaattcatacaggttggttggatagtagaattgcgatgagggtcagagctgaaaggccaccttggtacatctctgttgtgggaggagggctttacgtatgtacaactttttcacagctatcattaatttttccgttgttatgatctgtgttacttggactcgggttgttggatactggtatgtgtccacgtgtcggatacgtctaaatattcaattttacgcctaaaatgaagtatctaagtgccatgtccgagcatcaaggatcggacacgggtacgtgaagccaaatgaagagtccgagtaacataagttatgattaatgttaaataacttgttttctttatcctctatatccagaaagcatcgactagtagtgcagcgactgtttcagagtatataggctatcttgaaaaaggtcaaattcctccgaaggtatgtaacatacaattggttggcgggtgtttagattaacttattctattaatatcaattatactttcagtgttctgctttaattctggtttcatgattgcagcatatatcactcgtccactatgaagttgctctaaatatcgaggggatgaaatataccgtatgttccatgccattcgtactttcctcgtgaatttttgttatggatgctatttttgacattttctttctaaatatattttcttgaaattaatgaacatgtcgtttcggattgccagattgagatgattaggggtggaccaggaagctacaaaatgtggttgaatgggtccgtagttgaggcggaaatacatactttaagagatgggggtctcttgatgcaggtatcaaatgttttttgatatttttttttctgatatacggtatttatattttatatccaaagcatggtgataataccctggatttgtaaagcattagataatgtgttatcaaacaagtagaatgtagttttgtgaaatcgtgaagcgtttagtttagatttaaattttaatactcctacaatgcttgggatattaatcaataatcatgcttcaaatagtaaagagaaatattgtcatagactcataggtataatggctcgttaaatcatatgcacttcttgtttatgtgaagtccgagttggtgtttgcaatcaacgtttgaaatcaagggcatagtgctaaatctcgaatgtggtcacttttgtggtcaatgtagatggtttcatttctatcgtggtataaatatgggtcgcagtaatcttaagaacctatatagtagacgataacttgttattaaaagggtaaaggctgcatacatccgatgtcccatttacccggtctagatgtgagctacttggggttattgttattgaagttaaagatacaagagggattactgtttgaaaaaacggaatatttgaactacaaaaaaagtaattagtttaggtactagttcgttctagcccatataacacattttaaaaaaatatatgaaaaagggctttcaatgtcatgaacggaagggagcaaatggacagtggaagagtcaacaaagattacatatgatttatgaattctctttcgttgtttaaaaaactttgaaattgaaaattgttggctttttgttgaagaaacgatgtgtgtcagttgaaatcagaatatttaaactacaaaaaaagctattagtttatacacaatacacttgttcgtttaaacccatatagtacatttaaataattatttgaaaagggctgttaatgtgtgaaaactttcgatatgttgatctgattggatatgtgtcataccttgaaacgtcatgcagttggacggaaacagccatgtgatatatgccgaggaagaagctgcaggaactcgccttctgattgatggaagaacttgtttgcttcaggtaatgccgtgtgattctcttttttttttttttttgtgaattctaaaccttaaaaatcattctccaccaaacttgttcattttttcatatagaacgatcacgatccttcaaagctgattgcggagacaccgtgtaagcttatgcggtatttggtaccagataacagtcacatagatgcagatactccgtatgctgaagttgaggtcatgaagatgtgtatgcctttgctttccccagcatccggtgttttacaatttaagatgtccgaaggtcaagctatgcaggtatgcatcattttaatcgtaaattcagcaacctcgtttatattggattctaaatatggtcttgctgtgtaggctggtgaactcatagctagtctagagttggatgatccttcagctgtaagaaaagccgaacctttcagtggaagctttcctgtcatgggctcaccaactgcaatatctggaaaagttcatcagaggtgtgccgcaagtttaaatgccgctcggatgattttggctggttatgaacacaatatagatgaagtaagtttcaaaccaccatttcatttttcatcaacatagtttttaggctagcctcttaatgggttgatgccatagtgtaaaaacaaggccacatcgcatcacgtcaccgcgttgtaaaggatttcaaaaacaacgaaccgatatttcccacattgtgggctgtatcaagggatattttatggttttgaccggtatttaggcgttacaataaccgcatcactcccgttaccgcatcattgttctgttaccgtgatcatgaccgttaccgcatttttacactatggatgccgaaccttgagatgcatttcccatttttcaatagagcccctagtttttttcttcctgtttggaaattttttacatgtgagccttttattttctcaggtagtacagagtttgctggaatgccttgatagtcccgaacttccattccttcaatggcaagaatgcttgtctgtgctggcaacacgactccccaaagatctgagatacgaagtgtgtattctatcatctgttcttgatttagttatttatatttccttataataattttgaactttttcctcggaatttacagttggaatcaaaatctagagcttttgaagcgattaccaacaccccaaacatagaatttcctgctaagttgttgaaaagtattcttgaggttagtacctcactttgttaccttctgtaaattattcactcggcgagttactcatgttagtaacaagtttattcttcataggaccatttaaactcatgccaagagaaagataaaggagctcaagagaggcttattgagcctcttatggttcttgtaaagtcttacgaaggtgggcgagaaagtcatgctcgttttattgttcaatctttatttgaagagtatttatccgttgaagaattgtttagcgacaatctccaggtttgtccatctatctagagcaatttgattatgatgtttttttaaagttcataaattttagcttggtgccacaccgtcagtggctgatgatcgtcgctttgtgatcattaagcttttaaaagctgtctcctgttctccatcactatttttagaaattttgagttctgatgtatatactcggtacctgagggactctttggccgctttcttctttatgggtatgaattgcctccttccttccctccccagatcctgatcatagtttctatgagcgggatacattgggtatgatgatgattattattattattatcgctatttgaacaatttttcttatgttatttaactcctttttgtttttggcaaccgctttctcagccttatcttgtcaagggaagtgtcaggatgctgtggcacagatcaggtttcatagctttatgggaatttgttgaggagaatattgaccgaacaaatttttctgatgatctgactacaaacagtgggaaccatagtgagcgaaagtggggggccatggtcgttattaaaactcttcagttcttgccatcggtgattgctgcagcattgagagaaacaactcatagttccgatcaatcaacttccactggctctatagaatcagtcatccatggaaatatgctgcacattgcactagtgggggtgaacaaccagatgagcttgttgcaggataggtatataagactagcctgtaacatatggtgtaataatctttattatgtaaccttgtgcttctaatgtcctttatttctatggactatattgaagtacacttcttgttcatgtgatgttgatgttgataattgctaccgggtcaatcgaaaacaacctctttgttatcacttgaggtgttcaaaatagacccgatgactcgatattcatcagatcttgtaactgaactcgacttcaaaatgaatttaaaattatataaaaatcaatatggacacaagaccggatatcaatccgacccgaaatagttgactcgaaatcaacttgatgatccgaatgaacacctctagttatcactaacaagggtcagattgcgtacatcaaacccctcaaatcctgcttaggtgggagcttgtcaatggcttaggggtaacgggaatgtgtgtgctatgtacattgtgcatctattcttatacttatgttgagttttttggatcaaatataaagaacttaacttttgtattttcttgatgtggtgtagtggtgatgaagatcaggctcaagagagaatccataaattggccaaaattctgagagagcaagaagtgagttcagcccttcgtgctgctggtgttggtgtgattagttgcatcatacagagagatgaagggcgaactccgatgaggcattcattctattggtcagcagaaaaacaatattatagtgaggagcctttactacgtcatttggaaccccctctatctatgtatctcgagctggtactagtctctgaaccgattgcctttcttctgctttgttattctgtgtgatatttcgacttaagtctaatttacatcgttttgtacatttgttatccaaagcacgttaaaagatacttccttcgtttttttacaagcacccaaacacctttttacgcagcccaattggtttgtcgggttgcttatatatagaattatactcaacttaaaaattataaaatttgatattatgaaagtattcgacgtgacgaattaaacaaaatcccatatgactatgtttttttctcgtttgatagcnnnaatatgtaaaatactatcgaatgatgaatagtgtaaaaactggtttgggtgcaactaaaaaaatggaggaagtataattatgcagccaaaattgatggcttttaacttttcatcaaatcaggacaagcttaagggttatgaagatatcaaatatactccttcccgtgatcgtcaatggcatctttacacagttattgataaaccattcattcggaggatgtttttgagaacccttgtaagacaacccatctctgagttcacaggcgtcgaactaagcgctcttgaaacacaaaagcctatctctttcacttcaagaagcatcctaaggtccttaacaaccgccatggaggagttggagctcaatgcacatagtgcttcactgaaacccgatcacgctcatatgtacttgtacattgtccgagagcaacaaatatacgatcttgtgccatatcacaggtatctattgctgcgtgcctcaactttttttgtttattattggtcattagtacaccttattcttagaagaaacttttttcggccaattatttccagggaggtgaacatagatcaccaacaagaagaggcttcagttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatacctgttcggtacatgtaagtcataattttgagaacctcttttttgatcaagtcacaattttaatttttcacaaattcttgtatgagacggtctcaccgtgagaagcgccccatacttggattaaatagccgaataaaagaaacttttagcataatggaccttttgtatggactcgtctcatggtgagaaggtctcatacaataggggcaattaatttttagcttcttatctgtaaattttgcatagtacatagttttgaattttgagaggttgagtctatgtgacaacgaatatttaattgagtataatgttgtttaatccaaatatgatataaaagggtgtggcataagtgattgagcattcttttttcttttcaatgggaagttaaaggtctaaaccttggtataatttccttcaatgatgagcaatcaaagggattctaacctgtttatttatgactcgaaagtcgaacccaaaccagaacccgaacccgactcaacttgatttttttgacatgcctaaatggaactacagatgtattggggaaaataattaaactagaaaatggggaaaataattaaactagaaaatggggaaaacaatttacctagaatatgttttcagccaaaacaaacactcccaaatacatttcttagcatccacaaatgccgaggaattgcaatggaactccagttcctcggttcaacttagagaagtatataattcttttttgcacgatatcattatggttaattgacctgttttttctatgaaatataatttaatttttatgctctctagtttgttttactacacatgaatagttttggtttagagtgatcattttcttacaatattgatgcccaggtttatcgtgaattggaagatagcaacctacatgaaatggtctaccattcagtat

SEQ ID NO: 15 - DNA, 5302 bp, Amaranthus palmeri
aaccttgtgcttctaatgtcctttatttctatggactatattagagtacacttcttgttcatgtgatgttgatgttgataattgctacctggtcaatcacaaacaacctctttgttatcacttgaggtgttcaaaatagacccgatgactcgatattcatcagatcttgtaactgaactcgacttcaaaatgaatttaaaattatataaaaatcaatatggacacaagaccggatatcaatccgacccgaaatagttgactcgaaatcaacttgatgatccgaatgaacacctctagttatcacttacaagggtcagattgcgtacatcaaacccctcaaatcctgcttaggtgggagcagtgtcacatgattcgctagttaattcgcatgtctcgattcgagattcgctcaaaatggaccaaaaatggcccaaaaacgaccaaaattcgcttttttcaattcgcgattcgcagagagattaacgaattatgtgacagtgggtgggagcttgtcaatggcttaggggtaacggaattgtgtgtgctatgtatattgtgcatctattcttatacgtatgttgagttttttggatcaaatataaagagcttatcttttgtattttcttgatgtggtgtagtggtgatgaagatcaggctcaagagagaatcgataaattggccaaaattctgagagaacaagaagtgagttcagcccttcgtgctgctggtgttggtgtgataagttgcatcatacagagagatgaagggcgaactccgatgaggcattcattctattggtcagcagaaaaacaatattatagtgaggagcctttactacgtcatttggaaccccctctatctatgtatctcgagctggtactagtctctgaaccgattgcctttcttctgctttgttattttgtgtgatatttcgacttaagtctaatttacatcgttttgtacatttgttatccaaagcacgttaaaagatacttccttcgtttttttacaagcacccaaacacctttttacgcagtccaattggtttgtcgggttgcttatatatagaattttactcaacttaaaattataaaatttgatattatgaaagtattcgacgagacgaataaaacaaaatcccatatgactgtttttttctcgtttaatagctgtaatatgtaaaatactatcgaatgatgaatagtgtaaaaactggtttgggtgcaactaaaaaaatggaggaagtataattatgcagccaaaactgatggcttctaacttttcatcaactcaggacaagcttaagggttatgaagatatcaaatatactccttcccgtgatcgtcaatggcatctttacacggttattgataaaccattcattcggaggatgtttttgagaacccttgtaagacaacccatctctgagttcacaggcgtcgaactaagcgctcttgaaacacaaaagcctatctctttcacttcaagaagcatcctaaggtccttaacaaccgccatggaggagttggagctcaatgcacatagtgcttcactgaaacccgatcacgctcatatgtacttgtacattgtccgagagcaacaaatatacgatcttgtgccatatcacaggtatctattgctgcgtgcctcatttttttttgtttattattggtcattagtacaccttattcttagaagaaacttttttcggccaattatttccagggaggtgaacatagatcaccaacaagaagaggcttcggttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatacctgttcggtacatgtaagtcatagttttgagaacctcttttttgatctagtcacaattttgatttttcacaaattcttgtatgagacggtctcaccgtgagaatcaccccatacttggattaaatagccgaataatagaaacttttagcataatggaccttttgtatgaactcgtctcacggagagaaggtctcatacaataggggcaattaatttttagctttttatcggtaaattttgcatagtacatagttttgaattttgagaggttgagtctacgtgacaacgaatatttaagtgagtataatgttgtttaatccaaatatgatataaaagggtgtggcatatgtgattgagcattcttttttcttttctatgggaagttaaaggtctaaaccttggtataatttccttcaatgatgagcaatcaaagggtttcagacctgtttatttatgactcgaacctgaacccgactctacttgatttttttgacatgcctaaatggaactacagatttattggggaaaataattaaactagaaaatggggaaaacaatttacctagaatgcgttttccgccaaaacaaacactcccaaatacatttcttagcatccacaaatgccgaggaattgcaacggaactaccgatcctcggttcttcaacgtagagacgtatataattcttttttgcacgatatcattaaggttaattgacctgttttttctatgaaatataatttaatttttatgctctttagtttgttttactacacatgaatagttttggttttgagtgatcattttcttacattattgatgcccaggtttatcgtgaattggaagatagcaaccttcatgaaatggtctaccattcagtatctgttcacggcccccaccatggggtacctgtgaatgcaccctatcaaccactcggtggcatcgcccgtaagcgacttcaggccatgaaaagtagcacaacttactgttacgattttccactggtacggaatttgaaaatttcatcactccctcccccgtcttccccttaatatactttgtcgcccgttatttcatattccgttttatcaaccatgcaaggatcttccagggttccgaatttcattttttcgtacttccaaagtttcaggcaaacttactttttttgacgctgttgttttcaggctttctcaactgccctgaagcaatcatgggcatcggaagctccggatgtcaagaaaccctcggacaaagcgcttttgaaagtaacggagttagcgtttgctgatccaaaaggcacatggggaactccgcttgttccaataaatcgcaagcctggtatgaacgatgttggcatggtagcctggtacatggaaatgtccacccccgagttccctaatggaagaacaataatggttgtagctaatgatgttaccttcaaggccggatcttttggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaatcccgagagtggatttcagtatgtctacttaacccctgaagattacgatcgtataggatcgtcagtcatagcccacgagttaaaactcgaaagtggagaaaaaagatgggttatagataccgttgtaggtaaggaggacggattaggtgttgagaacctatcgggaagtggtgctatagccagtgcatactcaagggcttacaaggaaacatttactctgacttttgtaaccggaagaacggtcggtattggtgcctatcttgctcgtcttgggatgcgttgtatacagaggcttgaccagcctataattctcacgggtttttctgcgttaaataaacttctcggtcgggaggtttatagttcacacatgcaacttggtggaccgaagattatgggcacaaacggggtagttcatcttacagtatccgatgatcttgaaggcatttcatctatcttgaagtggctgagctacgttccaccctattcaggtggtgaacttccgatttctcggtgtttagaccctccaggaagaccggttgcgtatttgcctgaaaattcttgtgatcctcgtggtgctatatctggtacggttgactccaccggtaaatggtttgggggtattttcgacaaggatagttttgtggaaaccttagaaggatgggcacaaacagttgtcacgggaagggctaaactcggaggaattccagttggcatagttgccgttgagacgcagactgttatgcaagtaatcccagcagatcccggtcaactcgactcacacgagagagtcgtaccacaagcagggcaagtatggttcccagattctgcatccaagacagcacaagcgctgatggatttcaaccgggaagaactcccacttttcattttagctaattggagaggtttctcgggtggacaaagggatctctttgaagggatccttcaggccggatccaccatagttgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgattgagattaagttccgaaccaaggaacttctcgagtgtatgggaaggcttgatcaacaactcatcggtctcaaggaaaaactagccgaagccaagagctctaattcctacaataaaatcgagcccctgcagcaacaaataaaagcccgtgagaagcaactattgcctctatatactcaaatagccaccaaatttgccgagttgcacgatacgtctttaaggatggctgccaaaggagtcattagggacgtcttggaatggaaaagctcgcgttcgttcttttacaaaagattatacaggagagttatggaggaatcgctcgtcaagactgttcgagatgctgcaggtgaacggttgacccataagtcggctttggagttgatccaaaaatggttcaatgagtcgaatatttccggagaggcttccgatgcttgggctgatgatgcggccttctttaagtggaaggacaataccgccaactacgaggagaagttgaaagagttgcgcgttcagaaggtattggatcagctgtcgaatattggagattcggcaactaatttgagggctctgcctcagggtcttgctgccctacttcaaaaggtaatctgatttattttatgtacattctttgttctttctc

SEQ ID NO: 16 - DNA, 1693 bp, Amaranthus palmeri
aaatcattcccattaccgccatttagtaccactaaccaaacgggacggtaaagttttgcttactacaatatcttcttagctcataagctcagaaccttacttgaattttgacaatgtgtgtctagctatactttcaataagtatttaagaattcattttctttttatctatgtaaagttgcatatgatgtttgttataaagggtcaatcaaaaaactatctctttgttattagtaacaagggtaactgggtaaggttatgtacatccaatccctccaaaccctttttgggtgggagctacttaatggcgctgggacaatggaagtttttgtttgtcgaattcaagcggggaagtttgtttagaatgaatgttatttctaaaaatagatggtataagtatgttaatcaacaattaataatagagaactgttttattggtgtgataaacagtttcaggagcagtggtctcattttcgagcaatacaaaaagtgccgtgcttctctaaacaacgacgattcagacatgtcttctccttcccacaataatgaaaacccgaacggaccgatgatgccactcctgaggaattcatctgtagtatccattgttgataagttctgttatgctcttggagggacgcggccaatccatagtattttgatagcaaacaatgggatggctgctgtcaaatttataagaagtatccgaacatgggcttacgagacttttggtactgagaaggctatattattggtagccatggctactcccgaagacatgaaaatcaatgccgagcatattcgaatggctgatcagtttgttgaagtccccggaggaactaacaacaataactacgccaatgtgcagctcattgttgaggtaatgtatcttgagattagaaatttctagcctgtcatccatagttacatggaatgtggaacatagccacgttccgcgattcgggaacattcattcccaatcaccatgaaacccgacctaaatcgctaaaggtgacgtcccggtgtagaacaccttttttttaaaatgtatttttggccttcatttacaaattgaagaaaggaggaaaaaacaagatgtaacccagaaacctaaacaaatccacttgaaaataatttcttaaagcaaattaatcattttagtttaattttgtttcaaatatatattttatacataatgtatctcatacccaatcgttcttgagtaaatctaggttgcgttctgtgttcccattcttgtttcctgttcgaaaccaaatgtcgttcagttaacaatgctgttatctgctttactgtgatttattaaatgtgtccttcgaaaaaaggcaatatcagagcgacttgatgcagtatggcctggccggggacatgcgtagtttgttatatgagattgcaaatttatagccttttatatggtaaaatcttgtggtaggactaacttaaatcctttttctttcagttagcggaagttacacgagttgacgcagtttggcctggttggggacatgcatcggagatccccgagttgccagattcattagctacgaagggaattgtgtttctgggccccccagctgcatctatggctgctcttggagataaaattggttcatcattgattgcacaagctgcagatgtcccaactcttccatggagtggttctcatgtacgtactacac

SEQ ID NO: 17 - DNA, 1457 bp, Amaranthus palmeri
ggagacatcttgtgcctctaaccaaaccaaaccaacctccttaaacttctcttcttctactcaccattttttcctctttttattgattattgattattcattttaaatatacattatattgtaggaatttaatgaaattttcattaaattctgataaagttttgattttttttagtgtatgagatttttcttaagtacccaaatggtaaatttcaagtataatcaagttttttagtacccaaagctctaaatgttacttaaagttttgatcttttaatggtttcttctatttaatccaataatttaaagtacccagatttcaatttttagaataaattgagtttttgaattgcccaagttgtaattgttgctgaattctcttgctttgatttgggttttctgattctatcccttctgattcatacaggtattctgattttttcttgcttgattactttttgttagtgtatggttgagctaatttagtttatagtagtgtgaattttattttattttttttcaattttttcaattatttcaatttgtagagtagattctcctattatgatttgtttttgtagctgggttttaatttttattgtctgatgatttatcttagcaatgttttattgaagtgtattttagttgattccatttttccaatagagtgtacaaaatcgacctgattaactgaaactgagtattatccaacgggaacaatcactgttacaaaattcaaattagaatgtcaagtaccgaaatcaacccgaccccacatattatacccgagatccacccgaacacccgaatgaacacctctgagatcatagagaggatataagaaaagtgaaactagaatggggaatttagtttatttaagctacattgagcaaaaatttttttagtgactgattattgtagctggcttttgttgtataactcatctaagcaatgtttttgatgtgtgtgcagtagcattggattgttttgatttttttgttatattgtctatacaattcaattcttgaatcacacttgacttttagttccattttcatcttcacaaattcttgtgagagacggtctcagtgttagacgctctctgtacatgggctaaatagcccaactaatacaactattagcatacgagcttcttattttgaagtcatctctcataagagtagctctctatctttcgttgggtagatggtaataaacggtagtaatgaggatgaaaaacaagtgtaattttggttggaaaatatgttggttaccttgatggtcatgcttgtccaacttaaatcatcttattttcttctcaaaattcatttcaatgcattaccattaggagaggtgatattaggcggtaatgaaattatgtaaacaaaaaaacttttttgtgattgaagtttcattgctataggaacgatatcgatatggaacttttgatgaaattt

SEQ ID NO: 18 - DNA, 1175 bp, Amaranthus palmeri
tttttttttccttccaaatttctgatctttagagttttagtgatagatttatatacgtctctatccctcaggtgaaaattcctgctgagagttgcctagacgtaattcccgatgaagtatataaagcggcatgtgtttttactacagaggaagcaattgctagctgtcaagttgttggttatccggctatgatcaaagcttcttggggtggtggagggaagggaataagaaaggtaaaatttttttggatgatgatgctcttaaaagactaaaaggaggttacacatatccccattacttgtttatcatcagaggcggagcaaaaattgacaaagatttaaaggctgtgtgcaatttcaaaaaatatgatatatttctaacaacgtatcttcaaacactttaaacatactacctattctaatattgcggcccctatttttttgaggccgtgtgtggtcgaacatattgaatatgcttagaaccactcctgtttatcactaatatgccatcttccacaatcaaacctctacttttgacccagattccttgaaagggatttcgatttagactcgagctatggtcaattattagcaatagcaaaagcttcttaatagttaatagattctcaaacacttccgtcatgccaacactttatgaagactcatgggtattctctcttttaggttcataatgatgacgaagtacgggcattatttaagcaagtgcagggtgaagttcccggctcacccatatttataatgaaggtggcttcacaggttagactttcttcaacattggtccgatattcgagtaaattgcattaaaaaaggttaaatatacaatttttttggataagtattgtatgagagactactactaagataaagtattattaatatgtgcagagtcgacacttagaagtacagttactgtgtgatgaatatggcaatgttgcagcattgcatagccgtgattgcagtgtccaaaggcggcaccaaaaggtgggtctttggtagattatggttatgatctacggtttcttattgtttaagaaaaatatttgatattaagcattatttagcttgctgagatttgaacttttctgttcatcatattaactaatcagatcattgaagaaggcccaataacgatagctccaccagaaacggtgaaga

SEQ ID NO: 19 - DNA, 5038 bp, Amaranthus rudis
aagaacttgtttgcttcagaacgatcacgatccttcaaagctgattgcggagacaccgtgtaagcttatgcggtatttggtaccagataacagtcacatagatgcagatactccgtatgctgaagttgaggtcatgaagatgtgtatgcctttgctttcccctgcatccggtgttttacaatttaagatgtccgaaggtcaagctatgcaggctggtgaactcatagctagtctagagttggatgatccttcagctgtaagaaaagccgaacctttccgtggaagctttcctgtcatgggcgcaccaactgcaatatctggaaaagttcatcagaggtgtgccgcaagtttaaatgccactcggatgattttggctggttatgaacacaatatagatgaagtagtacagagtttgctggaatgccttgatagtcccgaacttccattccttcaatggcaagaatgcttgtctgtgctggcaacacgacttcccaaagatctgagatacgaattggaatcaaaatctagagcttttgaagggattaccaacacccagaacgtagaatttcctgctaagttgttgaaaagcattcttgaggaccatttaaactcatgccacgagaaagataaaggagctcaagagaggcttattgagcctcttatggctcttgtaaagtcttacgaaggtgggcgagaaagtcatgctcgttttattgttcaatctttatttgaagagtatttatccgttgaagaattgtttagcgacaatctccaggctgatgtgattgaacgtctccgccttcagtataagaaggatctgctgaagattgttgacattgtactgtcgcatcagggtgttaagaataaaaataagctgattctacgactcatggaacagctggtttacccaaatcccgctgcatacagggggaaacttatccgtttctctcaattgaaccatacaatgtattctgagttggcactaaaggccagtcaattgcttgaacaaacgaaattgagtgagctccgttcgaacattgctagaaacctctctgagctagaaatgtttaccgaggatggcgaaaacatggatactccaaaaagaaaaagtgctattaatgaacgtatggaggcgcttgtgagtactcctctagctgtcgaagatgcccttgttggtttgtttgatcatagtgatcatacacttcagaggcgggttgttgagacctatgttcggaggctttatcagccttatcttgtcaagggaagtgtcaggatgctgtggcacagatcaggcttcatagctttatgggaatttgttgaggagaatattgaccgaacgaatttttctgatctgactacaaacagtgggaaccatagtgagcgaaagtggggggccatggtcgttattaaaactcttcagttcttgccatcggtaattgctgcagcattgagagaaacaactcatagttccgatcaatcaacttccactggctctatagaatcagtcatccatggaaatatgctgcacattgcactagtcggggtgaataaccagatgagcttgttgcaggatagtggtgatgaagatcaggctcaagagagaatcgataagttggccaaaattctgagagaacaagaagtgagttcagcccttcgtgctgttggtgttggtgtgattagttgcatcatacagagagatgaagggcgaactccgatgaggcattcattctattggtcagcagaaaaacaatattatagtgaggaacctttactacgtcatttggaaccccctctatctatgtatctcgagctggacaagcttaagggttatgaagatatcaaatatactccttcccgtgatcgtcaatggcatctttacacggttattgataaaccattcattcggaggatgtttttgagaacccttgtaagacaacccatctccgagttcactggcgtcgaactaagcgctcttgaaacacaaaagcctatctcttttacttcaagaagcatcctaaggtcattaacaaccgccatggaggagttggagctcaatgcacatagtgcttcactgaaacccgatcacgctcatatgtacttgtacattgtccgagagcaacaaatatacgatcttgtgccatataacagggaggtgaacatagattaccaacaagaagaggcttcggttcaattctttttggaagatctcgcgcatgaaatccatagtcttgctggtgtaaggatgcataaactaaatgtttgtgagtgggaagtgaaacttcggatatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatctcccgtaagcgacttcaggccatgaagagtagcacaacatactgttacgattttccactggctttctcaactgccctgaagcaatcatgggcatcggaagctccggatgtcaagaaaccctcggacaaagcacttttgaaagtaaccgagctagcatttgctgatccaaaaggcacatggggaactccgcttgttccaataaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaaccccgagagtggatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcgggaggtttacagttcacacatgcaacttggtggaccgaagattaatgggcacaaacggggtagttcatcttacagtttccgatgatcttgaaggcatttcatctatcttgaagtggctgagctatgttccaccctattcaggtggtgaacttccgatttctcggtgtttagaccctcccgaaagaccggttgcgtatttgcctgaaaattgttgtgatcctcgtggggctatatctggtacggttgactccgccggtaaatggtttgggggtattttcgacaaggatagttttgtggaaaccttagaaggatgggcacgaacagttgtcacgggaagggctaaactcggaggaattccagttggcatagttgctgttgagacacagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatatacctatgatgggggagcttcgaggagggcatgggtggtcgtcgatagtcgaattaattccgaccatatagaaatgtacgccgaccaaacagctaaaggaaatgtacttgaacccgaaggaatgatcgagattaagttcagaaccaaggaacttctcgagtgtatgggaaggcttgatcaacaactcatcggtctcaaagaaaaactagccgaagccaagagctctaattcctatggtaaaatcgacccgcttcagcaacaaataaaagcccgcgagaagcaactattgcctctatatactcagatagccaccaaatttgccgagttgcacgatacgtctttaaggatggctgccaaaggagtcattagggacgtcttggaatggaaaagctcgcgttctttcttttacaaacgattatacaggagagtgatggaagaatcgctcgtcaagaccgttcgagatgctgcaggtgaacggttgacccataagtcggctttggagttgatccggaaatggttcaatgagtcgatatttccggagaggcttccgatgcttgggctgatgatgcagccttctttaagtggaaggataataccgctaactacgaggagaagttgaaagagttgcgcgttcagaaggtattggatcagctgtcgaatattggagattcggtaactaatttgagggctctgcctcagggtcttgctgccctacttcaaaaggtggatccatcgagtcgagaagaactagttgaggaactccgaaaagtgctcacttgattagcggccgttgatggtgaagtgaaaccttcttggtttcatcatggtagaaattattattaggcaaatctataattctagttacatcaattgtattagacaatagtatgaactaatttatttaattaaattgtataaataggaaaccttgaattcatttgaattaatcggcttatgcttgcattattttgtattgattcaattaataatttacatacttttgagtattaataatggaaaaaaaaaagaaaaaaaaacaaaacatgtcggccgcctcggtctctactga

SEQ ID NO: 20 - DNA, 1529 bp, Amaranthus rudis
cggttgcgtatttgccggaaaattcttgtgatcctcgtggtgctatatctggtacggttgactccaccggtaaatggtttgggggtatcttcgacaaagatagttttgtggaaaccttagaaggctgggcacgaacagttgtcacgggaagggctaaacttggaggaattccagttggcatagttgccgttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggccggatccaccattgtcgaaaatcttaggacttataatcaacccgtttttgtttatatacctatgatgggggagcttcgaggaggagcatgggtggtcgtcgatagtcgaattaattccgaccatatagaaatgtacgccgaccaaacagctaaaggaaatgtacttgaacccgaaggaatgatcgagattaagttcagaaccaaggaacttctcgagtgtatgggaaggcttgatcaacaactcatcggtctcaaagaaaaactagccgaagccaagagctctaattcctatggtaaaatcgacccgcttcagcaacaaataaaagcccgcgagaagcaactattgcctctatatactcagatagccaccaaatttgccgagttgcacgatacgtctttaaggatggctgccaaaggagtcattagggacgtcttggaatggaaaagctcgcgttctttcttttacaaacgattatacaggagagtgatggaagaatcgctcgtcaagaccgttcgagatgctgcaggtgaacggttgacccataagtcggctttggagttgatccggaaatggttcaatgagtccgatatttccggagaggcttctgatgcttgggctgatgatgcagccttctttaaatggaaggataataccgctaactacgaggagaagttgaaagagttgcgcgttcagaaggtattggatcagctgtcgaatattggagattcggtaactaatttgagggctctgcctcagggtcttgctgccctacttcaaaaggtggatccatcgagtcgagaagaactagttgaggaactccgaaaagtgctcacttgattagcggccgttgatggtgaagtgaaaccttcttggtttcatcatggtagaaattattattaggcaaatctataattctagttacatcaattgtattagacaatagtatgaactaatttatttaattaaattgtataaataggaaaccttgaattcatttgaattaatcggcttatgcttgcattattttgtattgattcaattaataatttacatacttttgattattaataatggaaatcctcaaagtttaaggggattgtttctaaaaaaaaa

SEQ ID NO: 21 - DNA, 1103 bp, Amaranthus rudis
ggggccatggtcgttattaaaactcttcagttcttgccatcggtgattgcctgcagcattgagagaaacaactcatggttcagatcaatcaacttccactggctctatagaaccagtcatccatggaaatatgttgcacattgcactagtcggggtgaataaccagatgagcttgttgcaggatagtggtgatgaagatcaggctcaagagagaatcgataagttggccaaaattctgagagaacaagaagtaagttcagcccttcgtgctgttggtgttggtgtgattagttgcatcatacagagagatgaagggcgaactccgatgaggcattcattctattggtcagcagaaaaacaatattatagtgaggagcctttactacgtcatttggaaccccctctgtctatgtatctcgagctggacaagcttaagggttatgaagatatcaaatatactccttcccgtgatcgtcaatggcatctttacacggttattgataaaccattcattcggaggatgtttttgagaacccttgtaagacaacccatctccgagttcacaggcgtcgaactaagcgctcttgaaacacaaaagcctatctcttttacttcaagaagcatcctaaggtccttaacaaccgccatggaggagttggaactcaatgcacatagtgcttcactgaaacccgatcacgctcatatgtacttgtacattgtccgagagcaacaaatatacgatcttgtgccatatcacagggaggtgaacatagattaccaacaagaagagacttcggttcaattctttttggaagatctcgcgcatgaaatccacagtcttgctggtgtaaggatgcataaactaaatgtttgtgagtgggaagtgaaacttcggatatcatctcccgggaaagctaatggtttatggagggtggcggttacaaatgtgactggtcagacctgttcggtacatgtttaccgtgaattggaagataacaacctacatgaaatggtctaccattcagtatccgttcacggcccccaccatggggtacctgtgaatgcaccctatcaaccactcggtggcatcgcccgtaagcgac

SEQ ID NO: 22 - DNA, 541 bp, Amaranthus rudis
agatgctttctttcttgcagttacaaatcttgcttgtgcaaagaaacttcctcttatttatctggctgcaaattcaggagctcgacttggtgttgccgaagagctaaaatcctgctttaaagttggctggtcggatgagtcaaaccccgagagtggatttcagtatgtctacttaaccccggaagattacgatcgtatcggatcgtcagtcatagcccacgagttaaaactcgaaagtggagaaaaaagatgggttatagacacagttgtcggtaaggaggacggattaggtgtcgagaatttatcaggaagtggtgctatagcaagtgcatactcaagggcttacaaggaaacatttactctgacttttgtaaccggtagaacggtcggtattggtgcctatcttgcacgtcttgggatgcgttgtatacagaggcttgaccagcctataattctcacgggtttttctgcgttaaataaacttctcggtcgggaggtttacagttcacacatgcaacttggtggaccgaagattatgggc

SEQ ID NO: 23 - DNA, 1511 bp, Amaranthus rudis
ttttaagaacgtaatttctttttatttatgagaagttgcagatgatgtttgttataaatggtcaatcgaaaaactacctctttgttatcagtaacaagggtaaggttgtatatatccgactcctccaaactcttcttcggtgggagctacttaatgtcgctggggcaatggaagttgttgtttgtcgaatttaagtggagaagtttgtttacattgaattttaattagatggtataagtatgttatcaaagatttataattgaaaactggtgtgataaacagtttcaggagcagtggtctcattttcgagcaatacaaaaagtgccgtgcttctctaaacaacgacgattcagacatggcttctcattcccaaaatagtgaatacctgaatggaccgatgatgccactcctgaggaattcatctgtattacccattgtggataagttctgttatgctcttggagggacgcggccaatccatagtattttgatagcaaacaatgggatggctgctgtcaaatttataagaagtatccgaacatgggcttacgagacttttggtacagagaaggctatattattggtagccatggctactcccgaagacatgaaaatcaatgccgagcatattcgaatggctgaccagtttgttgaagtccccggagggactaacaacaataactatgccaatgtgcagctcattgttgaggtaatgtattgtgagattagaaatttctagcctattatccatagttacatggaacgtggaacgtagccacgttccgtgatccgggaacattcattccccaatcaccacgaaatgcgacctaaatcgctcaaggtgacgtctcggtgtagaacaccttttttaaaatgtattttggccttcatttacaaattaaagaaaaaagaaaggaggaacaaacgagatgtaacccagaaacctaaaaaagatccacttgaaaataatttcttaaagcaaattaatcattttagtttaattttttttcaaatatatattttatacgtaatgtatctcgtacccaatcgaacctgtcgttccaggtaacaatgctgttatctgctttattgtaatttattaaatgtgtcctctgaaaaaatggcaatatccgagcaacttgacgcagttttgcctggccagagacatgcgtaatttgttatatgagattacaaatttatagccttttatatggtaaaatcttgtggtaggactaacttaaatcctttttctttcagttagcggaagttacacgagttgacgcagtttggcctggttggggacatgcgtcagagatccccgagctgccagattcactaagtgcgaagggaattgtgtttctagggcccccagctgcatctatggctgctcttggagataaaattggttcatcattgattgcacaagctgcagatgtcccaactcttccatggagtggttctcatgtacgtattacacgttttttccaaatttttgatcattagaattttag

SEQ ID NO: 24 - DNA, 1246 bp, Amaranthus rudis
cataccaatgtccgagcatcaaaaatcggacacgggtacgtgaagcaaaataaagagtccgagtaacatacttatgattaatgttaaataacttattgtctttattgtctatatccagaaagcatcgactagtagtgcagcgactgtttcagagtatataggctatcttgaaaaaggtcaaattcctccgaaggtatgcaacataccagtggttggcgggtgtttagattaacttattctatttatatcaattatactttcagtgttctgctttaattctggttttatgattgcagcatatatcactcgtccactatgaagttgctctaaatattgaggggatgaaatatactgtatgttccatgccactcgtactttcctcgtgaatttttgtaatggatgctatttttgacattattctttctaaatatgttttcctgatattaatgaacatgtggtttcggattgccagattgagatgattaggggtggaccaggaagctacaaaatgtggttgaatgggtccgtaattgaggcggaaatacatactttaagagatgggggtctcttgatgcaggtataacctgtttttttggattttttccgatatacggtatttttattttatatggaccctggatttgaaaagcattagataatgtgctatcgaacaagtagaaggtagttttgtgagaccgtgaagcatttagttaaacccattgttaagattaccttttagatttagtacttctacaatgcttgggatattaatcaataatcatgcttttaataataaagagaaatattgtcatagactcataggtataatggctcgttaaattatatgcacttcttgtttatgtgaagttcgagatgctgtttgtaatcaactttggaaatcgagggcatagtgcaaaatctcggatgtggtcacctttgatgcaacaatctcaaagccacttttgtggtcaatgtagatggtttcatttttatcgtggtataaatatgggtcgcggtaatctcaagaacccatatagtagacgataacttgttattaaaagggataaggctgcatacatccgatgtcccctttaccctgtctagatgtgagctacttgggggttttcctattgaagttaaagatacaagaaggatttctgttaaaaaaaaaggaatatttgaactacaaaaaagtaataagtttatatactagttcgttctaacccatatagcacattttaaaaaa

SEQ ID NO: 25 - DNA, 780 bp, Amaranthus rudis
tcagccttatcttgtcaagggaagtgtcaggatgctgtggcacagatcaggcttcatagctttatgggaatttgtggaggagaatattgaccgaacaaatttttctgatgatctgactacaaacagtgagcgaaagtggggggccatggtcgttattaaaactcttcagttcttgccatcggtgattgctgcagcattgagagaaacaactcatggttcagatcaatcaacttccactggctctatagaaccagtcatccatggaaatatgttgcacattgcactagtcggggtgaataaccagatgagcttgttgcaggataggtacgtaagactagcctgtaacatatggtttaatagttttattatgtaaccttgtgcttttaatgtcatttatttctagccgatattacgtaagactagccgatattcatccgatcttgtaactgaacccgacttcaaaatcaaatttaaattatatataaatcaacgtggacataagacccgattttaatctgacccgaaatcaacccaatgacccgaatgaacacctatagttatcactaacaagggtcaggttacgtacatcaaacccctcaaatcctgcttaggtgggagcttgtcattggcattggggtaacgggaatgtgtgtgctatgtacattgtgcatctattcttatacttatgttgtgagttttttggatcgaatataaagagcttatcttttgtattttcttgatgtgctgtagtggtgatgaagatcaggctcaagagagaat

SEQ ID NO: 26 - DNA, 342 bp, Amaranthus rudis
ttgcttgaacaaacgaaattgagtgagctccgttcgaacattgctagaaacctctctgagctagaaatgtttaccgaggatggcgaaaacatggatactccaaaaagaaaaagtgctattaatgaacgcatggaggcccttgtgagtactcctctagctgttgaagatgcccttgttggtttgtttgatcacagtgatcatacacttcaaaggcgggttgttgagacctatgttcggaggctttatcaggtgaatacatacttaattgcggagttagcttcagcttcactcagtcctattcgttgcaagaacttctcttgatctttctcgagtcgagggact

SEQ ID NO: 27 - DNA, 755 bp, Amaranthus spinosus
ttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgatcaacaactcatcggtctcaaggaaaaactagccgaagccaagagctctaattcctacaataaaattgagcccctgcagcaacaaataaaagcccgtgagaagcaactattgcctctatatactcaaatagccaccaaatttgccgagttgcacgatacgtctttaaggatggctgccaaaggagtcattagggacgtcttggaatggaaaagctcgcgttcgttcttttacaaaagattatacaggagagttatggaggaatcgctcgtcaagactgttcgagatgctgcaggtgaacggttgacccataagtcggctttggagttgatccaaaaatggttcaatgagtcgaatatttccggagaggcttccgatgcttgggctgatgatgcggccttctttaagtggaaggacaataccgccaactacgaggagaagttgaaagagttgcgcgttcagaaggtattggatcagctgtcgaatattggagattcggcaactaatttgagggctctgcctcagggtcttgctgccctacttcaaaaggtggatccatcgagtcgagaagaactagtcgaggaactccgaaaagtg

SEQ ID NO: 28 - DNA, 605 bp, Amaranthus spinosus
aagaacggtcggtattggtgcctatcttgctcgtcttgggatgcgttgtatacagaggcttgaccagcctataattctcacgggtttttctgccttaaataaacttctcggccgggaggtttatagttcacacatgcaacttggtggaccgaagattatgggcacaaacggggtagttcatcttacagtttccgatgatcttgaaggcatttcatctatcttgaagtggctgagctacgttccaccctattcaggtggtgaacttccgatttctcggtgtttagaccctccagaaagaccggttgcgtatttgcctgaaaattcttgtgatcctcgtggtgctatatctggtacggttgactccaccggtaaatggtttgggggtattttcgacaaagatagttttgtggaaaccttagaaggatgggcacgaacagttgtcacgggaagggctaaactcggaggaattccagttggcatagttgccgttgagacgcagactgttatgcaagtaatcccagcagatcccggtcaactcgactcacacgagagagtcgtaccacaagcagggcaagtatggttcccagattccgcatccaagacag

SEQ ID NO: 29 - DNA, 577 bp, Amaranthus spinosus
gaggtgaacatagatcaccaacaagaagaggcttcagttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatcgcccgtaagcgacttcaggccatgaaaagtagcacaacttactgttacgattttccactggctttctcaactgccctgaagcaatcatgggcatcggaagctccggatgtcaagaaaccctcggacaaagcgcttttgaaagtaaccgagcttgcatttgcggatccaaaaggcacatggggaactccgcttgttccaataaatcgcaagcctggtatgaacgatgttggcatggtagcctggtaca

SEQ ID NO: 30 - DNA, 1492 bp, Amaranthus thunbergii
gtgctattaatgaacgtatggaggcgcttgtgagtactcctctagctgtcgaagatgcccttgttggtttgtttgatcatagtgatcatacacttcagaggcgggttgttgagacctatgttcggaggctttatcagccttatcttgtcaagggaagtgtcaggatgctgtggcacagatcaggcttcatagctttatgggaatttgttgaggagaatattgaccgaacgaatttttctgatctgactacaaacagtgggaaccatagtgagcgaaagtggggggccatggtcgttattaaaactcttcagttcttgccatcggtaattgctgcagcattgagagaaacaactcatagttccgatcaatcaacttccactggctctatagaatcagtcatccatggaaatatgctgcacattgcactagtgggggtgaataaccagatgagcttgttgcaggatagtggtgatgaagatcaggctcaagagagaatcgataagttggccaaaattctgagagaacaagaagtgagttcagcccttcgtgctgttggtgttggtgtgattagttgcatcatacagagagatgaagggcgaactccgatgaggcattcattctattggtcagcagaaaaacaatattatagtgaggaacctttactacgtcatttggaaccccctctatctatgtatctcgagctggacaagcttaagggttatgaagatatcaaatatactccttcccgtgatcgtcaatggcatctttacacggttattgataaaccattcattcggaggatgtttttgagaacccttgtaagacaacccatctccgagttcactggcgtcgaactaagcgctcttgaaacacaaaagcctatctcttttacttcaagaagcatcctaaggtcattaacaaccgccatggaggagttggagctcaatgcacatagtgcttcactgaaacccgatcacgctcatatgtacttgtacattgtccgagagcaacaaatatacgatcttgtgccatatcacagggaggtgaacatagattaccaacaagaagaggcttcggttcaattctttttggaagatctcgcgcatgaaatccatagtcttgctggtgtaaggatgcataaactaaatgtttgtgagtgggaagtgaaacttcggatatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatctcccgtaagcgacttcaggccatgaagagtagcacaacatactgttacgattttccactggctttctcaactgccctgaagcaatcatgggcatcggaagctccggatgtcaagaaaccctc

SEQ ID NO: 31 - DNA, 1214 bp, Amaranthus thunbergii
gatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcctataattctcacgggttttctgcgttaaataaacttctcggtcgggaggtttacagttcacacatgcaacttggtggaccgaagataatgggcacaaacggggtagttcatcttacagtttccgatgatcttgaaggcatttcatctatcttgaagtggctgagctatgttccacactattcaggtggtgaacttccgatttctcggtgtttagaccctcccgaaagaccggttgcgtatttgcctgaaaattgttgtgatcctcgtggggctatatctggtacggttgactccgccggtaaatggtttgggggtattttcgacaaggatagttttgtggaaaccttagaaggatgggcacgaacagttgtcacgggaagggctaaactcggaggaattccagttggcatagttgctgttgagacgcagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgaccaacaactcatcggtctcaaggaaaaactagccgaagccaagagctctaattcctacgataaaatcgagcccctgcagcaacaaataaaagcccgcgagaagcaactattgcctctttatactcagatagccacca

SEQ ID NO: 32 - DNA, 1121 bp, Amaranthus thunbergii
taagagatgggggtctcttgatgcagttggatggaaacagccatgtgatatatgcagaggaagaagctgcaggaactcgccttctgattgatggaagaacttgtttgcttcagaacgatcacgatccttcaaagctgattgcggagacaccgtgtaagcttatgcggtatttggtaccagataacagtcacatagatgcagatactccgtatgctgaagttgaggtcatgaagatgtgtatgcctttgctttcccctgcatccggtgttttacaatttaagatgtccgaaggtcaagctatgcaggctggtgaactcatagctagtctagagttggatgatccttcagctgtaagaaaagccgaacctttccgtggaagctttcctgtcatgggcgcaccaactgcaatatctggaaaagttcatcagaggtgtgccgcaagtttaaatgccactcggatgattttggctggttatgaacacaatatagatgaagtagtacagagtttgctggaatgccttgatagtcccgaacttccattccttcaatggcaagaatgcttgtctgtgctggcaacacgacttcccaaagatctgagatacgaattggaatcaaaatctagagcttttgaagggattaccaacacccagaacgtagaatttcctgctaagttgttgaaaagcattcttgaggaccatttaaactcatgccacgagaaagataaaggagctcaagagaggcttattgagcctcttatggctcttgcaaagtcttacgaaggtgggcgagaaagtcatgctcgttttattgttcaatctttatttgaagagtatttatccgttgaagaattgtttagcgacaatctccaggctgatgtgattgaacgtctccgccttcagtataagaaggatctgctgaagattgttgacattgtactgtcgcatcagggtgttaagaataaaaataagctgattctacgactcatggaacagctggtttacccaaatcccgctgcatacagggggaaacttatccgtttctctcaattgaaccatacaatgtattctgagttggcactaaaggccagtcaattgcttgaacaaacgaaattgagtgagctc

SEQ ID NO: 33 - DNA, 5705 bp, Amaranthus viridis
aggcacagtcggtgaaacctaaaggtcattgtattgctgcgcgtgtgacaagtgaggatcccgatgacggttttaagcctacaagcgggaaagtacaggagctgagttttaaaagtaaaccgaatgtgtgggcctacttctctgttaagtctgggggaggcattcatgagttctcggattctcaatttggccatgtttttgcatttggtgaaaaccgaggtttggccatagcaaatatgattcttggattaaaagaaattcaaattcgtggagaaattcgaactaatgttgattacaccatcgatcttttaaattgtttggattatagagaaaaccaaattcatacaggttggttggatagtagaattgcgatgagggtcagagccgaaaggccaccttggtacatctctgttgtgggaggagggctttacaaagcatcgactagtagtgcagcgactgtttcagagtatataggctatcttgaaaaaggtcaaattcctccgaagcatatatcactcgtccactatgaagttgctctaaatatcgaggggatgaaatataccattgagatgattaggggtggaccaggaagctacaaaatgtggttgaatgggtccgtagttgaggcggaaatacatactttaagagatgggggtctcttgatgcagttggatggaaacagccatgtgatatatgctgaggaagaagctgcaggaactcgccttctgattgatggaagaacttgtttgcttcagaacgatcacgatccttcaaagctgattgcggagacaccgtgtaagcttatgcggtatttggtaccagataacagtcacatagatgcagatactccgtatgctgaagttgaggtcatgaagatgtgtatgcctttgctttcccctgcatccggtgttttacaatttaagatgtccgaaggtcaagctatgcaggctggtgagctcatagctagtctagagttggatgatccttcagctgtaagaaaagccgaacctttccgtggaagctttcctgtcatgggcgcaccaactgcaatatctggaaaagttcatcagaggtgtgccgcaagtttaaatgccactcggatgattttggctggttatgaacacaatatagatgaagtagtacagagtttgctggaatgccttgatagtcccgaacttccattccttcaatggcaagaatgcttgtctgtgctggcaacacgacttcccaaagatctgagatacgaattggaatcaaaatctagagcttttgaagggattaccaacacccagaacgtagaatttcctgctaagttgttgaaaagcattcttgaggaccatttaaactcatgccacgagaaagataaaggagctcaagagaggcttattgagcctcttatggctcttgtaaagtcttacgaaggtgggcgagaaagtcatgctcgttttattgttcaatctttatttgaagagtatttatccgttgaagaattgtttagcgacaatctccaggctgatgtgattgaacgtctccgtcttcagtataagaaggatctgctgaagattgttgacattgtactgtcgcatcagggtgttaagaataaaataagctgattctacgactcatggaacagctggtttacccaaatcccgctgcatacagggggcaaacttatccgtttctctcaattgaaccatacaatgtattctgagttggcactaaaggccagtcaattgcttgaacaaacgaaattgagtgagctccgttcgaacattgctagaaacctctctgagctagaaatgtttaccgaggatggcgaaaacatggatactccaaaaagaaaaagtgctattaatgaacgtatggaggcgcttgtgagtactcctctagctgtcgaagatgcccttgttggtttgtttgatcatagtgatcatacacttcagaggcgggttgttgagacctatgttcggaggctttatcagccttatcttgtcaagggaagtgtcaggatgctgtggcacagatcaggcttcatagctttatgggaatttgttgaggagaatattgaccgaacaaatttttctgatctgactacaaacagtgggaaccatagtgagcgaaagtggggggccatggtcgttattaaaactcttcagttcttgccatcggtaattgctgcagcattgagagaaacaactcatagttccgatcaatcaacttccactggctctatagaatcagtcatccatggaaatatgctgcacattgcactagtgggggtgaataaccagatgagcttgttgcaggatagtggtgatgaagatcaggctcaagagagaatcgataagttggccaaaattctgagagaacaagaagtgagttcagcccttcgtgctgttggtgttggtgtgattagttgcatcatacagagagatgaagggcgaactccgatgaggcattcattctattggtcagcagaaaaacaatattatagtgaggaacctttactacgtcatttggaaccccctctatctatgtatctcgagctggacaagcttaagggttatgaagatatcaaatatactccttcccgtgatcgtcaatggcatctttacacggttattgataaaccattcattcggaggatgtttttgagaacccttgtaagacaacccatctccgagttcactggcgtcgaactaagcgctcttgaaacacaaaagcctatctcttttacttcaagaagcatcctaaggtcattaacaaccgccatggaggagttggagctcaatgcacatagtgcttcactgaaacccgatcacgctcatatgtacttgtacattgtccgagagcaacaaatatacgatcttgtgccatatcacagggaggtgaacatagattaccaacaagaagaggcttcggttcaattctttttggaagatctcgcgcatgaaatccatagtcttgctggtgtaaggatgcataaactaaatgtttgtgagtgggaagtgaaacttcggatatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatctcccgtaagcgacttcaggccatgaagagtagcacaacatactgttacgattttccactggctttctcaactgccctgaagcaatcatgggcatcggaagctccggatgtcaagaaaccctcggacaaagcacttttgaaagtaaccgagctagcatttgctgatccaaaaggcacatggggaactccgcttgttccaataaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaaccccgagagtggatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcgggaggtttacagttcacacatgcaacttggtggaccgaagataatgggcacaaacggggtagttcatcttacagtttccgatgatcttgaaggcatttcatctatcttgaagtggctgagctatgttccaccctattcaggtggtgaacttccgatttctcggtgtttagaccctcccgaaagaccggttgcgtatttgcctgaaaattgttgtgatcctcgtggggctatatctggtacggttgactccgccggtaaatggtttgggggtattttcgacaaggatagttttgtggaaaccttagaaggatgggcacgaacagttgtcacgggaagggctaaactcggaggaattccagttggcatagttgctgttgagacgcagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgaccaacaactcatcggtctcaaggaaaaactagccgaagccaagagctctaattcctacgataaaatcgagcccctgcagcaacaaataaaagcccgcgagaagcaactattgcctctttatactcagatagccaccaaatttgccgagttgcatgatacgtctttaaggatggctgccaaaggagtcattagggacgtcttggaatggaaaagctcgcgttcgttcttttacaaaagattatacaggagagttatggaggaatcactcgtcaagactgttcgagatgctgcaggtgaacggttgacccataagtcggctttggagttgatccggaaatggttcaatgagtcagatatttccggagaggcttccgatgcttgggctgatgatgcgaccttctttaagtggaaggacaataccgctaactacgaggagaagttgaaagagttgcgggttcagaaggtattggatcagctgtcgaatattggagattcggtaactaatttgagggctctgcctcagggtcttgctgccctacttcaaaaggtggatccatcgagtcgagaagaactagtcgaggaactccgaaaagtgctcacttgatttcgcaaccgttgatggtgaagtgaaaccttcttggtttcatcatggtagaaaatattattaggcaaatctataattttagtgacatcaattgttttagacaatagtattgaactaatttatttaattaaattgtataaataggagaccttgaattcatttgaattaagtggcttatgcttgcattatttgtattgaatcaaataattatttacatac

SEQ ID NO: 34 - DNA, 2186 bp, Ambrosia trifida
cagttggaatgggaattccactttggcaaataccagaaattagacggttttatgggatggataatagtggaggttatgatgcttggagaaaaacatcggctcttgcaaccccttttgactttgaccaagcagagtcaattagaccaaggggtcattgtattgctgttcgtgtaacgagtgaggatccagatgatggttttaagccaccggtggaaaagtacaggaactagttttaaaagcaagccaaatgtgtgggcatacttttctgtcaagtctggaggaggcattcatgaattttcggattcccaatttggtcatgtttttgcatttggagagtcaagaacgttggctattgcaaatatggttcttgggctgaaggaaatccaaattcgtggagaaattcgtactaatgttgattatacaatcgatctattacatgctctggattatagagaaaacaaaatccatacaggttggttagatagccgaattgctatgcgggttagagcagaaaggcccccatggtacctttcagtagttggtggagctctttataaagctgctgctagaagtgctttacatggtttctgactatgttggttatcttgaaaagggtcaaatccctcctaagcatatatcattggtcaactctcaagtttctttgaatattgagggtagtaagatacacgattgatatgctgaaaagaggaccaggaagttacagactgagaatgaatcaatctgaaattgaagcagaaatacatactctacgtgatgggggtttactgatgcagttggatggaaatagtcatattatatacgcagaggaagaagcagctggtactcgtcttctaattgatggacgaacttgcttgcttcagaatgatcatgatccttccaaattggtggcggaaacaccatgcaagcttctaagatatttagtctcagatggtagccatgttgatgctgacacaccttatgttgaggttgaagtgatgaaaatgtgtatgccacttctttcgccggcttctggagttatacaatttaaaatgtccgaaggtcaagccatgcaggctggtgagcttatagcaagactagatcttgatgatccgtcagctgtaagaaaagcagagccctttcctggaagctttcctgttctgggcccaccgaccgccatttcagataaagttcatctgaaatgtgctgcaactctgaatgctgctcggatgattcttgctggctatgatgacaacattgatgatgttgtacaaaatctgcttctttgtctggatagcccggagcttcctttcctacaatggcaagaatgcttcgcagtattagcaaatcgacttgataaagatctaagaaacaagctagaatcaaagtttaaggagtacgaaggaatttccactcaacaagctatcgacttccccgccaaagttttacggaacattctagaaactcacctcggatcttgctcagaaaaagagaaggtggcccaggaaagactcattgaaccgttaatgagtctcgttaagtcatatgacggtggtagagagagtcatgcacgcgggattgttcatgctctttttgaagagtatttatctgttgaagaattatttagtgacaatattcaggctgatgtaatcgaacgtctacgactccaatacaacaaagatctcttgaggattgttgacattgtgctttcccatcagggagttaggagtaaaaacaagctgatactacgactgatggagcatttggtctaccctaatccagctccttatagagagaaactcatacggttttctgcactcaaccacacaagttattctgagttagcattgaaggcaagtcaattgctggaacaaactaaattaagtgaacttcgttcaagtattgcaagaagtctatctgaattagaaatgtttaccgaagaaggtgagaatatcgatacccctaaaagaaaaagtgcaattaacgaaagaatggaggatatcgtgagtgctcctttggcggttgaagatgcccttgttggtctttttgaccatagtgatcacacccttcaaaggcgtgttgttgagacctatgttagaagattatatcagccatatctggtgaaggggagtgttagaatgcaatggcacagattgggacttattgcatcatggcaattcgtggaaggg

SEQ ID NO: 35 - DNA, 1838 bp, Ambrosia trifida
taatcctgaagattacagtcgaatcaaatcgtcagtgattgcacatgaattttgtctggagagtggtgaaaccagatggattattgatacaattgtaggaaaggaagacggattaggggttgagaatttaagcggtagcggggccattgctggtgcgttttcgaaagcatataaagaaacgttcaccttaacatatgtgacgggaagaaccgttgggataggagcttatttggcccgtttgggaatgaggtgcatacaacggaccgaccaaccaataatcttgaccgggttttcggccctgaacaagcttttgggccgagaggtttacagctcgcaaatgcaacttggagggccgaagatcatggggacaaacggtgttgttcatttaacggtttctgacgatctggaaggcgttatggcaatcataaattggttgagctttgttccaccgtatgttggtggcccgcttcctgttttggcagcagtggacccggtagaccggcctgtggagtaccagcctgaaaactcgtgtgatcctcgtgcggctgtttgtggtacagtggatgggaatgggaaatggttaggagggattttcgatagagacagttttgtggaaacattggagggttgggctaggacggttgtaacgggccgggccaaacttggtgggatccccgtaggggttattgctgtcgagacgcaaacagtgatgcaaataatacctgcggatcctgggcagctcgactcacacgaacgtgttgtcccgcaagctgggcaggtgtggttccctgattctgctagcaaaactgctcaagctttaatggattttaaccgcgaagagcttccgctgttcatcatggcgaactggcgggggttttctgctggtcaacgggatctttttgaaggaattttacaggcgggatcgacaattgttgagaaccttagaacgtataaacagccggttttcgtttacatcccgaaaaccggcgagcttcgtggcggcgcgtgggtggttgttgacagtcgaatcaactcggaccatatagaaatgtatgcagaaacaaccgcaaaaggaaatgttcttgaacccgaaggtatgattgaaattaagttccgaaacaaggaattgttagaatgtatgaaccgactggacccgcaaatccgaaacctcaaacaaaaattacaagaaacaaaatacgaccaaacaatcaccgaccagataaaagcccgtgagaagcaacttctgcccatttacactcagatcgccaccaagttcgcggagcttcacgacacatctttccgaatggctgaaaaaggcgtggtgaaaaaggttgttgactggaacatttctcggtttttcttctacaaaaggctccgccgtcggctcgcagaagcttctttaataaataccacacgtgatgccgccggtgacacacttacctacaatgctgcttatgatatgatcaagaaatggtttttggccacgaagacggaagaagtttggcttgatgatgatgtgtttttcacatggaaagatgacccgtctaattacaccgataagttagccacattacgtacacagaaggtttcgaatcagctattaaagtttggtggttcaccgtctgatctggaagctttaccgcaggggcttgctgcacttctgcaagaggtggatccagcgactaaaagtaaactaattgaagacatccggcgtgtcattgagacttggccggctaaatgagaagccattcgggcaatgtatactatttagaactactacatgtaagaatatttattttccttgaatatttttgtaaataaatcacacatttccaatc

SEQ ID NO: 36 - DNA, 818 bp, Ambrosia trifida
gcagattattcctgcagatcctgggcaacttgattcacatgaacgggtggtcccacaagctgggcaggtgtggttcccggactctgctagtaaaacggctcaagctataatggattttaaccgagaagagctccctcttttcattatggccaactggcgggggttttcagcgggtcaacgtgacctttttgaagggattttacaggcgggatccacaattgttgagaatctgagaacgtataaacagccgttttcgtttacattccaaaaaccggtgaacttcgtggtggtgcatgggtggttgtggatagtcggatcaattcagaccatattgaaatgtatgcagaaaccactgccagaggaaatgttcttgaacccaaggaatgattgaaatcaaattccgaaataaagaattgttggactgcatgagccgactcgatccacaaatccaaattcttaaaggaaaacttaaagagtccaaatacgatcaaagaatcggcgaccagataaaagcccgtgagagacagcttttaccaatatacactcagatcgccacgaaattcgctgagcttcatgacacatcgttccgaatggctgaaaaaggggtggtaaaagaagtggttgactggaaagcttctcggtttttcttctacaaaaggctgcggcgtaggctgggggaggcttctttgataagtagcatgcgtgatgctgcgggtgggacgctgtcgtacaagtcggcttatgatatgattaagaaatggtttctggagagcaaaggggaagcagagttgtgggttgatgatgatgcttttttcaca

SEQ ID NO: 37 - DNA, 505 bp, Ambrosia trifida
  unsure (1)..(505): unsure at all n locations
ttgattgctcngtttggcagtggaagcatgtcagaagctcaaagactgcctttaaatggaagcagcttaaactacaacatttccttgaggtcttctgcagctagatctgctgccattgatgagttttgttatgcacttggtggaaataggcccattcataatattcttgttgcaaacaatggaatggctgctgttaagtttataacaagtgtcagaacatggagctacgaaacatttggttcagaaaaagctatttcattggtcgccatggctactccagaagatatgaggataaatgcagagcatattagaatcgctgatcagtttgttgaagtccctggtggtacaaataataataattatgctaatgtgcaactcattgtagagactgctgagataacacatgtcgatgcggtttggcctggttggggtccatgcatctgaaatccctgaactaccagatgcattggaggctaaaggaattatatttcttgggccacctgct

SEQ ID NO: 38 - DNA, 4795 bp, Ambrosia trifida
aaataccatttcttacattatgaggcaaataaaaaaaaatatcagttacttctaaaagttcatttcattaaataaacaaattatcaaacagcgttcttacgttggtcattttctgtgcataatgttctttttgcttgctattttataaagtggaactgattgttataaatagctgttatattttactttctatgagatgcatacatatgatatttttagtgttttgaaatcgtaaatatgattttatgaaatgttgaggttttggaaggattataagacttgcccaaaggtttgttttcattatctaacatattgacttgaattgcacttttgtaggagcttagtttcaaaagcaagccaaatgtgtgggcatacttttctgtcaaggtaaatttatatttacatattttgatgcaatttcccaattcaaaaatataaatatatttttatttaaaaattgcagtccggaggaggcattcatgaattctcagattctcaatttggtaagaaaactgaatcttgtttggttttagtttttaacagtcatactgctggtgtagttggctttacacgattctttgctaaagcattcgttatcttatttaattattattttgtacgctttaggtcatgtttttgcatttggagagtcaagagcactggccattgcaaatatggttcttgggttgaaagaaatccaaattcgtggtgaaatccgtactaatgttgattatacaatcgacttattacatgtgagcatcttggttcttttgctccctttgttccaaattttattgcctacaaaaagtactccataatttaagaaatgcacaagcaaatcagattttaatcagcagagtgccagtttaccctgaatgcatctaaaatacggtaaaattttaagataagtgtaatcaagggtgaaactagaaaactaataaattacaacatttcatttctagaacaggacagttattatgatacaaattaaaaaagaaaagtagacaaattttgagacgggtcgactgtcatgaagttaatagattacatacgttttttttacagaattacttatgtacatgcttcatattgagaaattgattaaatttacaaattctttatttcttgtacattagctttatgattttgattcttttacacttaataattttattattattatttctacatttgtaggctccggattatagcgaaaacaaaatccatacaggttggttagatagccgaattgctatgcgggttagagcagaaaggcccccatggtacctttcagtagttggtggagctctttatgtaagtggtttgttaataatacttttccttttctatattcaccaccgtttaatgtactcttgtcttactgttgatttttgttgacctcagaaagctgctgctagaagtgcagccatggtatcagattatgttggttatcttgaaaagggtcaaatccctcctaaggtattttgacttagcattgacctttatgttgacctcagaatgccctttgcttaatttttttttcttttcttgaagcatatatcattggtcaactctcaagtttctttgaatattgagggtagtaagtacacggtaagtaataacataaatttctgttcttgatctctgtttttttttaattattatttttcttctaatttatgtgtttgttttttgtaagattgatatggtaaaaaaaggaccaggaagttacagattaaaaatgaatcactctgagattgaagcagaaatacatactctacgcgatgggggtttgttaatgcaggtaaacatttttgtttatttttcaagttaaagtcctatgggtatgggatacatgatttgcttcataaataaaatcaaaagatacaatatttacagtcatgcaaatttgttacatttttacatgtatttacacatttgtttgtcacatgcctatatttatataatattgattggataatttaatattgtagttggatggaaatagccatattatatatgcagaggaagaagctgccggtactcgactcctaattgatggacgaacttgcttgcttcaggtgtcaacaactacttctttttgttgttgtttacttctttttgttgttgttgttattattattattatttattatagatgtggctgtttctatgcatttacttttgagttgattgatttaggtcatatgttatctttaatgggtaaaaaagtttagcctaaaacgagacgggtcagttggatccattaggttgaaagtcacctgtagtttatctattacgcataatgtgattagaccacctgattgcattaaaaaaaatataaaaccctcatttcaatccaaacggactcgtttagacaatcttccatttttgaccaatacccgcccattatcccacatctgtttgttattcactaatttgttctatatttggtttaatttgttgttagaatgatcatgatccttccaagttgatggcagaaacgccatgcaagcttctaagatacttagtgtctgatggtagccatgttgatgctgacacaccttatgttgaggttgaagtgatgaaaatgtgtatgccacttctttcgccggcttctggagttatacaatttaaaatgtccgaaggtcaagccatgcaggttagatttaaatatcttcttaatatttattgtttttgcgaaatatatacaaaaatttccttttacgaacattaatgaaaaatcaattctgaatctacatgagaatttaatttatttatttttttatatatggacatcttttctgagtaaaattttggcattgtagttgttttttctttattttataactctaactttttcaaaaaggtaatatctaagatatttagaggcataatgagtcactttttacaattaatattattcccaattgtttcagttacaaatattatattggtacgtcagtgctcgattttttgttgtttacacaaattctctccataatacaatcatatctttatcttctatacagcatgcatacatgggatgcactttttgtcctaaattttgaacatatgaatgtttttatatgtaggctggtgagcttatagcaagactagatcttgatgatccgtcagctgtaagaaaagcagagccctttcctggaagctttcctgttctgggcccaccgaccgccatttcagataaagttcatctgaaatgtgctgcaactctgaatgctgctcggatgattcttgctggctatgatgacaacattgatgaagtaatcttgtttttattttattctttttgccatttaaataacccatatgaaatattttaatcaactaatcacaactttatgtagtggtgaaaaatttaacccacaatttatgaacgggtcgacttgggttatgttgatccataagtggtcaaacacaaaaatagaaatgctcaaaagataatggtcatatgggtcaagtcagccaaagtgtattcttatgcataaaacctcctaaatcatttttattcaaaaaaattaacttcttttaataatataaattttggaatagtatttgatatgctaattatatataactaaatttagtttttgaacaagtgttaagggtcaagcaagcctaacttgctttgattgacacaaaattatgcattattccataccggttttgactcgtgacccatcccgccaagtcgttcttttttctcaccattagcttagttcttcaatgagcttactttcttttaaatttttctttttgttatttataacatgtttaatctttgattttaggttgtgcaaaacctgcttctttgtctggatagtcctgagcttcctttccttcaatggcaagaatgctttgcagttctagcaaatcgacttcctaaagatctaagaaacaaggcaaattaatgtcttataatcatgttgtttatttaagttattattgtaacattttttttctaatttttaattcttctataacagttggagtcgaagtttaaggagtacgaaggaatttccacccaacaagctatcgaattccccgccaaagtgttacgggccattctagaagttagtttacgatcaaatacttataatttgacttttttcgtatttaaatatttagtttactttatactatacttttgtaatgtttatggttagacgcaccttggatcttgcttagaaaaagagaaagttgcccaagaaagactcattgaaccgttgatgagtcttgttaagtcatatgaaggtggcagagagagtcatgcacgtgggattgttcatgcactttttgaaaaatatttatccattgaagaattatttagtgacaatattcaggtgaagtttttaactgattagtataaaaaatgcaaaatttcatatataaactttatagtatcatatttattttttcaaatttccatggtgaaacaaataacgaatgcaaaagcaatgttattactgtgaatcatgtctacacataatgctcttataagtaattaatttgcatgcactttaacatcatactctttcatgttgagtaaatttttcttaaatgtaaaatgaaatttttttctttaggctgatgtaatcgaacgtctacgactccaatacaacaaagatctcttgaggattgttgacattgtgctttcccatcaggtatatatgttatttttagaggttgcaaaatggactgtgggatgggtttgtcaacgggtcaaaatttgccattttgctaagggttgataccggttgggttgggttgggtt

SEQ ID NO: 39 - DNA, 4587 bp, Ambrosia trifida
ttttcaaaaaaaaaaaattaaaaaaaaaaatagtgtctacttcttttttgtattaaatttatttgcacataactcttttataaagcaagtcatgtttgtacattttaacttcaaagactcatgacacgaaaataaaacgaataagttaaatttgtttacataatattgtgctacatttacatatatacttgttatccaatagttaattatgatgatttacatttttaattatttgtgttcaaagtttgtttaaactcactggataatcttgggagttaaggcaagtatggcattgaaaagtagaaccctgggccctgaaacagcgattgaaaaaaagcagtggcgatgggtcgaactggtcaattcaaagggtccctttatcagcaaattacttggacaattttgacttttactttgacctcttccaataatatagcttttttttattccttctaattttaactacaaatatacatgtttgtttttctacacactttcaacatctgtacatttctatcagtttgtctacagtatataatcgcaagaatatttcgacttataatcatagatattctgtttgcacttatagcatgcaaaatacagatgcatagaatttgcatacgcctaaaagtgcagagaaaaatcatgtgaacattcttatgtccgttttataaatgttgctcacaaatagacaaaaatattactgtttttttgttatactatgtagaaaaagtcatgcaaatcacatacatatggattgttttataacaattacaaattgtgtgcaggagagttgacgtagattctgggaccgaagagggtgtggttgaggcacttttggtgaagttggctcgtgagatacacacaatggttggtataaaaatgcaccggttaggtgtttttgagtgggaggttaagcttcgcatggtgtcttctggtcaagccaatggtgcctggagggtggtggtcactaatgtgaccggtcatacgtgtattgtacatgtaagttaaaaggccattttagacatttcaacaataggtaaactctttttgctcatacatgcttaatgttactctttgcgattttcatttaggtctatcgggaaatcgaggataatgttgaacacaaggtagtttatcatgctacctcgacatcaagccccttacatggtgtatctgtgaacacaccatttcagcctttgaaattactcgatcagaaacgtcttttggcccgtaaaagcaatactacttactgctatgactttgcactggtaaaattgccattttgcccttctacttttaatgcatgcatgttcttttatttaaaagtagtaaaattaccattctgccctttcgaacttggattatggttaattcttacggatcttgcttttgtatccgcaggcatttgaagcagcccttgagaatatctggtcattgaaactcccaggtgtcaacaagcccgttggtaagcttgtaaatgtgacagagctcgcatttgctgacccgagaggctcatggggtacaccgcttgtgcaaataaaccgtgagccgggccagaacaatgcgggcatggtggcttggaccatggacctctgcacacctgagtttcctcatggaaggacaattttggtagttgcaaacgatgtcacgtttaaaaatgggtctttcggcccgattgaggacgcgtttttcgaggcggtcaccgaacttgcctgttccaagaaactgccactcatttacctggcagcgaactcgggggcccgaattggggcggctgaggaggttagatcttgctttagaattgggtggtccgatgaatcgaaccctgattcagggttccagtatttgtacctaactcctgaagattacagtcgaatcaaatcgtcagtgattgcacatgaattttgtttggagagtggtgaaaccagatggattattgatacaattgtaggaaaggaagacggattaggggttgagaatttaagcggtagcggggccattgctggtgcgttttcgaaagcatataaagaaacgttcaccttaacatatgtgacgggaagaaccgttgggataggagcttatttggcccgtttgggaatgaggtgcatacaacggaccgaccaaccaataatcttgaccgggttttcggccctgaacaagcttttgggccgagaggtttacagctcgcaaatgcaacttggagggccgaagatcatggggacaaacggtgttgttcatttaacggtttctgacgatctggaaggcgttatggcaatcataaattggttgagctttgttccaccgtatgttggtggcccgcttcctgttttggcagcagtggacccggtagaccggcctgtggagtaccagcctgaaaactcgtgtgatcctcgtgcggctgtttgtggtacagtggatgggaatgggaaatggttaggagggattttcgatagagacagttttgtggaaacattggagggttgggctaggacggttgtaacgggccgggccaaacttggtgggatccccgtaggggttattgctgtcgagacgcaaacagtgatgcaaataatacctgcggatcctgggcagctcgactcacacgaacgtgttgtcccgcaagctgggcaggtgtggttccctgattctgctagcaaaactgctcaagctttaatggattttaaccgcgaagagcttccgctgttcatcatggcgaactggcgggggttttctgctggtcaacgggatctttttgaaggaattttacaggcgggatcgacaattgttgagaaccttagaacgtataaacagccggttttcgtttacatcccgaaaaccggcgagcttcgtggcggcgcgtgggtggttgttgacagtcgaatcaactcggaccatatagaaatgtatgcagaaacaaccgcaaaaggaaatgttcttgaacctgaaggtatgattgaaattaagttccgaaacaaagaattgttagaatgtatgaaccgactggacccgcaaatccgaaacctcaaacaaaaattacaagaaacaaaatacgaccaaacaatcaccgaccagataaaagcccgtgagaagcaacttctgcccatttacactcagatcgccaccaagttcgcggagcttcacgacacatctttccgaatggctgaaaaaggggtggtaaaagaagaagtggtggttgactggaaagcttcttctcggtttttcttctacaaaaggctgcggcgtaggctgggggaggcttctttgataagtagcatgcgtgatgctgctggtgacacgcttacctacaatgctgcttatgatatgatcaagaaatggtttttggagagcaaaggggaagcagagttgtgggttgatgatgatgcttttttcacatggaaagatgacccgtctaattacactgataagttagccacattacgtacacagaagatatcaaatcagttattaaagattggtggttcaccgtccgatctggaagctttaccgcaggggcttgctgcacttctgcaagaggtaactgttgtttcttgaatcttgacgactacattcctttcaccattttgcaagtcgagaataagattgtttttaatgtcgttttgtttgttgtgtttcaggtggatccagcgactaaaagtaaactaattgaagacatccggcgtgtcattgagacttggccggctaaatgagaagccattcgggcaatgtatactatttagaactactacatgtaagaatatttattttccttgaatatttttgtaaataaatcacacatttcgaatcatatcaaataattattcattgtagtcttttctgtaatcggtatttgcgatatctatgtttgagtatttattaactaattatacaaatctttgttgggctttgcactttctggatcaacaactcagacctcgtgatcaagctttggtgaacatgaatgaactgcatctgcaacagtgagaaaaatcttgttttccccaatcaagtcggggaaacctgatgcgtatagcttgtctagcacttgttgacccgggttcgcaagaataagctgtcaaaccaaaatattattgttttagcacgcaattgcggaaattattatgaaaactttttatccgttgttaaccgtataataaatgagttgatgatatgtgtagtagtgtttaatcgcataaaattacatgttttgttctcaactggttttggcacgtttacttgtaatattataaacagtattgctgctgcttacttggacatctctcttttgcagactacggtataactcttccaaggcatggattccacttgtgtcgatatcagtaaccgctgcagttagagaacactctttaaacaaagtattcgccccgctcattaaatattcatgactgactataggaaatagaagagcttctttcttacgtgacaattccactatcaagaactgaattttgggttgaaaagttgctgcttttagattatcttcttcctcagctagccatcttaatatcctgcaacgaattatagctttcaaggatggaaacatacatacatacatagttaaactcc

SEQ ID NO: 40 - DNA, 2723 bp, Ambrosia trifida
atggggacaaacggtgttgttcatttaacggtttctgacgatctggaaggcgttatggcaatcataaattggttgagctttgttccaccgtatgttggtggcccgcttcctgttttggcagcagtggacccggtagaccggcctgtggagtaccagcctgaaaactcgtgtgatcctcgtgcggctgtttgtggtacagtggatgggaatgggaaatggttaggagggattttcgatagagacagttttgtggaaacattggagggttgggctaggacggttgtaacgggccgggccaaacttggtgggatccccgtaggggttattgctgtcgagacgcaaacagtgatgcaaataatacctgcggatcctgggcagctcgactcacacgaacgtgttgtcccgcaagctgggcaggtgtggttccctgattctgctagcaaaactgctcaagctttaatggattttaaccgcgaagagcttccgctgttcatcatggcgaactggcgggggttttctgctggtcaacgggatctttttgaaggaattttacaggcgggatcgacaattgttgagaaccttagaacgtataaacagccggttttcgtttacatcccgaaaaccggcgagcttcgtggcggcgcgtgggtggttgttgacagtcgaatcaactcggaccatatagaaatgtatgcagaaacaaccgcaaaaggaaatgttcttgaacccgaaggtatgattgaaattaagttccgaaacaaggaattgttagaatgtatgaaccgactggacccgcaaatccgaaacctcaaacaaaaattacaagaaacaaaatacgaccaaacaatcaccgaccagataaaagcccgtgagaagcaacttctgcccatttacactcagatcgccaccaagttcgcggagcttcacgacacatctttccgaatggctgaaaaaggcgtggtgaaaaaggttgttgactggaacatttctcggtttttcttctacaaaaggctgcggcgtaggctgggggaggcttctttgataagtagcatgcgtgatgctgcgggtgggacgctgtcgtacaagtcggcttatgatatgattaagaaatggtttctggagagcaaaggggaagcagagttgtgggttgatgatgatgcttttttcacatggaaagatgaaccaaagaactacaggcacaagttaagtgagttacgtgcacgcaaggttgcaaatgagttattaaagattggtggttcagcgtcggatgtggaagcgttggcgcaggggctggctgcacttctaaaagaggtaactgttgtttcttgaatcttgacgactacattcctttcaccattttgcaagtcgagaataagattgtttttaatgtcgttttgtttgttgtgtttcaggtggatccagcgactaaaagtaaactaattgaagacatccggcgtgtcattgagacttggccggctaaatgagaagccattcgggcaatgtatactatttagaactactacatgtaagaatatttattttccttgaatatttttgtaaataaatcacacatttccaatcatatcaaataattattcattgtagtcttttctgtaatcggtatttgcgatatctatgtttgagtatttgtgaaccttttattaactaattatacaaatctttgttgggctttgcactttctggatcaacaactcagacctcgtgatcaagctttggtgaacatgaatgaactgcatctgcaacagtgagaaaaatcttgttttccccaatcaagtcggggaaacctgatgcgtatagcttgtctagcacttgttgacccgggttcgcaagaataagctgtcaaaccaaaatattattgttttagcacgcaattgcggaaattattatgaaaactttttatccgttgttaacgtataataaatgagttgatgatatgtgtagtagtgtttaatcgcataaaattacatgttttgttctcaactggttttggcacgtttacttgtaatattataaacagtattgctgctgcttacttggacatctctcttttgcagactacggtataactcttccaaggcatggattccacttgtgtcgatatcagtaaccgctgcagttagagaacactctttaaacaaagtattcgccccgctcattaaatataggaaatagaagagcttctttcttacgtgacaattccactatcaagaactgaattttgggttgaaaagttgctgcttttagattatcttcttcctcagctagccatcttaatatcctgcaacgaattatagctttcaaggatggaaacctacatacacacatagttaaaatccgatggtttgtacctttctttgatgtaatttgaatttgagaaataaatagcagaatcaatcctaacaattacaacacccggaattttattcgcttctggatactgtccgatattccggtacacgctggtcatcggaatcttcccaagaagcgcggttcgtgggcgtgtaacttgcagaagaatcttagcaaaagatatcgccacctgattcaacaatcttattaaacaaaagctcaaaattgacctaaaaacaatgttttcataaccagttcaatggttgggcccaaatgccatcataaataatttatttatttatatgaataatatataaactataaagtaagtagtaaatggatcactaaatgat

SEQ ID NO: 41 - DNA, 2408 bp, Ambrosia trifida
gttgacctgaaacatgtttttgttttcaaaagttttagataatttgttagtcaaatatgatgaaatatacaaattattatttcaataataatccagtttttttaaaaagatataggtgatatgtgtacagtaaaaagatacaatttggtaggtatttcacaagttcaggcgctagaaacatgtccttttaagattttgttctgccttgtaccttttgaacgtttaaagcagaacccgactcgacccattcatgagtaaatgggttgaaattgccgtctctagtttttctggttttatgtttccacttattaatattaaataaaatttattctgaagtcgatattttaaatttaacagggagttaggagtaaaaacaagctgatactacgactgatggagcatttggtctaccctaatccagctccttatagagagaaactcatacggttttctgcactcaaccacacaagttattctgaggtcaatatcgtcatttaacatactcaaaggctctaactaactacttttttttattggcatatttaacttcattatcattaatttaacagttagcattgaaggcaagtcaattgctggaacaaactaaattaagtgaacttcgttcaagtattgcaagaagtctatctgaattagaaatgtttaccgaagaaggtgagaatatcgatacccctaaaagaaaaagtgcaattaacgaaagaatggaggatatcgtgagtgctcctttggcggttgaagatgcccttgttggtctttttgaccatagtgatcacacccttcaaaggcgtgttgttgagacctatgtcagaagattataccaggtatgcagttggtttttctcttaaacatatactatctatccatttaagtcgccattgactaatacagctcaataaaaaaagttaaaaggatggatgtgattaatttgtaaatatcaaaatcaagtctattgtatattgatatttggtatgataaacaaggggcaaatgagtaattgtaccttgtaattctattttcagccatatcttgtgaaggggagtgttagaatgcaatggcacagattgggacttattgcatcatggcaattcgtggaagggcatactgaggaattgaatgcttctggaccattggttgataggaaatggggagctatggttattattaaatctcttcaatttttgcccgatgtgataagtgcagctcttaaagaaacgactcaaactgggtcagcaggtcatactattactaaccatggtaacatgatgcacattgcattggccggcatcaacaaccaaatgagtttgcttcaagacaggtttgaccatacaagtcaacatcatcatgtttggttataaatcaatttataaaaattcattatctctagaattgaaaccaaattatatttatatatttgatattaactaatacgcgcatattttcttataaactgcagtggtgatgaggaccaggcccaagaaagagtcaatcggttagcaaaaatattaaaggacaaagaactaagctcgagtctaaaaaacgcagggtatgatgttataagttgtataatacaaagagacgaaggtaggggcccaatgagacattcatttcattggtcagaaagtaatcgttattatgtcgaagagccattattgcgccatgtggaacctccattatctatttaccttgaactggtttgtactcatagcccgcttcattttgtttccatttctttaaatagtaataatactaaggacaaatgtccacaaaaagtgaaatcgagtcagcttttagcacattaggcttccacgttatcgtttttacatgattggatgccatgtcagcagttttaagcattttgtatgccgtgtcaacttatgcaacctaactctttgcagtaacacacattaaagtgttgcaatagcgacacattttagaagagaagtaaattttataaatactcataattttagaaggtttcggtaaaaaagtattagtttccagaaaggtctaaaattatttatgtcactatatatcttggcatttttatccacactcagtgaccagttttgttgtgttgctaaatttcaattttggtgcagcgaccctcttttaaagacttagtgaacaacggggacattcgattaccatttaatgacatattccctaatattagaagaaaagttatataaatttccatgtattataaattggttattttttcaggataaactgaagggctatgagaatatacagtacactccatcgcgcgacaaacaatggcacatgtatacggttgatgcgaaaccacttccggttcgcagaatgtttcttcgagcacttgtaagacaaccaacaaaagaatggttttcgccctcgggataccatgattc

SEQ ID NO: 42 - DNA, 1771 bp, Ambrosia trifida
tggcggccgtaaagtttataagaagtgtgagaacatggagttatgaaacatttggttcagaaaaagcaattttgttggtagccatggcgactccggaggatatgaggataaatgcagagcatattagaattgctgatcaatttgtggaagtcccaggtggtacaaataataataattatgcaaacgtgcaactcattgtggaggtatataggtttcatacatatataatttatttaggcatcaactgatgtattttatgaaccaccatacacgccattttattgcaaagtaaccattgttctttagaacagtcttattttgacttttcggtcaaattatctgtttataaacgttcattcctgcaacgataagtcagatatgatggttcaagaagtcggtcactaaacaagggttggatttaccttcacttattcagaagtccttaaaatattacatttgctctctacaaagtattttttactatgaattttcaagtggactacatcaattttgtaattaatacgaaattacaaatgtgtgtaacttttgatgaaaaatcctactttgacatacctaactatatccttaagttataacattgatattgcaatgcttaacttttgaggaaaatcattacctacatcatgtttaatgattgcagactgctgagataacacatgttgatgctgtttggcctggttggggtcatgcatctgaaatcccggaactaccagatgcattggaggctaaaggaattatatttcttgggccacctgctgcttccatggcagctttaggagataaaatcggttcatcgttgattgcactagcagctgatgtgccaacacttccatggagtggctctcatgtaagttttgccacttttatagtcagtcctttttagttttttcagaaaaaaaaaactcatttcatacctcttgtttttcaaaaaactggttcctaatgctacttattttttaaaaactgcatctttactagtctttataacacctcatctttttagctcgtattcttttacaattgcacctataaacctcaaaaatctcatctttattctgcttattatataaaatatcctgctttaggtgaaaattcctgtggaaagctgtttggccacaatcccagatgatgtatatagaaaagcttgtgtatctacaactgaagaagcaattgctagctgtcagtttattggttatccggctatgatcaaggcatcatggggcggaggtggcaaaggcataagaaaggtttgtttccttcaacttgacctttaaaagtcaataaactagttttgacctcaaagcacttatttatttttgttaatttaggtgcataatgatgaagaagtcaaggcacttttcaagcaagttcaaggtgaagtgccaggttcacctatattcattatgaaagttgcctcccaggtgagaaaacgtttgaataactcatctgatcttaatgtgtgacttaaaacttattataacactatttaaatattattttaaaaccagagccggcatctagaagttcagctactgtgtgatcagcatggcaatgtagcagccttacatagtcgtgattgcagtgttcaaagacgacaccaaaaggtagtctgagaatcgcagtctttctaaaaaataacaaatcttgattttaatataattttttatatttttttaagattatcgaggagggtccaattaccgtagctccacctgacacaataaagaagcttgagcaagcagcaagaaga

SEQ ID NO: 43 - DNA, 1320 bp, Ambrosia trifida
catgatgagtgatgacatatgtggtctttcactctaattcttgcaattgtcgatgctttcgactcttgtcttctttacggtaattagtcttcttcccctttcccccaaatttaaaaaagaaactaaagtttgatagctctgtttggcagtggaagcatgtcagaagctcaaagactgcctttaaatggaagcagcttaaactacaacatttccttgaggtcttctgcagctagatctgctgccattgatgagttttgttatgcacttggtggaaataggcccattcataatattcttgttgcaaacaatggaatggcggcagtaaagcttataagaaatgtgagaacatggaggtatgaaacatttggttcagaaaaagcaattttgttggtagccatggctaccccggaggatatgaggataaatgcagagcatattagaattgttggtcaatttgtagaagtgcctggtggaacaaataatgataataatgcaaacgtgcaactcattgtagaggtatataggtttcatacatatataatttatttaggcatcaactgatgtattttatgaaccaccatacacgccattttattgcaaagtaaccattgttctttagaacagtcttattttgacttttcggtcaaattatctgtttataaacgttcattcctgcaacgataagtcagatatgatggttcaagaagtcggtcactaaacaagggttggatttaccttcacttattcagaagtccttaaaatattacatttgctctctacaaagtattttttactatgaattttcaagtggactacatcaattttgtaattaatacgaaattacaaatgtgtgtaacttttgatgaaaaatcctactttgacatacctaactatatccttaagttataacattgatattgcaatgcttaacttttgaggaaaatcattacctacatcatgtttaatgattgcagactgctgagataacacatgtcgatgcggtttggcctggttggggtcatgcatctgaaatccctgaactaccagacgcattggaggccaaaggaattgtatttcttggcccccctgcttcatccatggcggctttaggagataaaattggttcttctttgattgcacaagcggctgctgtaccaacacttccatggagtggttctcatgtaaatattgccacttttatagtcggtcctttttagttttttcagaaaaaaaaaactcatttcatacctcttgtttttcaaaaaactggttcctaatgctacttattttttaaaaactgcatctttattttattttttt

SEQ ID NO: 44 - DNA, 7026 bp, Conyza canadensis
atgaattttcgggcatttgatctgaagctcaacatttttctgggcgattcaaataagcgttttactgttacaaaaagtttcgtctcaacgggtgaccactacacgacttctgataacaccaatccgaccagtcttacaaaggtgaaggtgaagaaacatgtgaagagggataaatttggagaaagaatggcatcactaaaacagatagtgtcaccctatggcaaggattttgctaaacatagttgtaagggttatagttacaacacaatagaatggagtctagacttggaccattgtgttttagagaagaagggaatcgaacgcaaagtttgcgttgtgatagtcaggagacagaaagggcaatttgtttctgttctttttaagttagatagtggcaccatgtcagaagctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaagtattttaattgcaaataatggaatggcggctgtaaagtttataagaagtgtgaggacatggagttatgaaacatttggctcagataaagctattttgctggtagccatggctacaccggaagatatgaggataaatgccgagcatattagaatcgctgatcagtttgttgaagtccctggtggtacaaataataataattatgcgaatgtgcaactcattgtagagactgctgagataacacatgttgatgctgtttggcctggttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcatgtaaaaattcctgtggatagctgtttggacacactcccggatgatgtatatagaaaagcgtgtgtgcatacaacagaagaagcaattgctagttgtcaagttgttggttatccagcaatgattaaggcatcatggggtggaggtggcaaaggcataagaaaggtgcataatgacgaagaagtcaaggcactttttaagcaagttcagggtgaagtgcctggttcccctattttcattatgaaagttgcttctcagagccgacatctagaagtgcagctactatgcgatcaacatgggaatgtagcagctttgcatagtcgtgattgcagtgttcaaaggcgacatcaaaagattattgaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggttgagcatccagtcacagagtggatagcggaaatcaatctacctgcagcacaagttgcggttggaatgggcattcctctttggcaaataccagaaataagacgattttatggaatggacaatagtggaggatacgatgcttggaggagaacatctgctcttgcaactccatttgactttgacaaggcagagtctatcagcccaaaaggtcattgtattgctgtacgtgtaacaagtgaggacccagatgatggatttaagcccactagtggaaaagttcaggagctaagttttaaaagcaagccaaatgtctgggcatacttttctgtcaagtccggaggaggcattcatgaattctcagattctcaatttggccacgtttttgcatttggcgagtcaagacctttggctattgcaaatatggttcttgggctgaaggaaattcaaattcgtggcgagatccgtacgaatgttgattatacaattgatctgttacatgctcctgattatagagaaaataaaatacataccggttggttagatagccgaattgctatgagggttagagcagaaaggcccccttggtatctttcagtagttgggggagcactttataaagctgctgctagaagtgcagccatggtctcggactatgttggttaccttgaaaagggccaaatccctcctaagcatatatcattggtcaactcacaagtttctttgaatattgagggcagcaaatacacgattgatatggtaaaaagagggccaggaagttacagattgagaatgaatcaatccgagattgaagcagagatacatacactacgtgacggaggcttattgatgcagttggatgggaatagtcatatattatacgccgaggaagaagctgccggtactcgcttgcttattgatggacggacttgcttgcttcagaatgatcatgatccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggctggtgagcttatagcaaggctagatcttgacgatccgtcagctgtaagaaaagcagagcctttcaatggaaactttcctcttcttgggcctccaacggccatgtcagacaaagtgcatcagaagtgtgctgcaactttaaatgctgctcgaatgattctcgcaggctatgatcataacattgatgaattggaatccaagtttaaggagtacgaaggaatttccacacaacaaactattgactttcctgctagagttctacgggtcattcttgaaacccatcttggatcttgctcagaaaaagaaaagggagcccaagaaaggctcgttgagccattaatgggtcttgtaaagtcatatgaagggggaagagaaagtcatgcacgtgggatcgttcatgctctatttgatgaatatttatctgttgaagagttgttcagcgacaacattcaggctgatgtaatcgaacgtcttcgacaactatacaagaaagatctcttgaggattgtcgacattgtcctttcccatcagggtgttaggagtaaaaacaaattgatactacggctgatggagcatttggtttaccccaatccggctgcgtatagggagaaactgatacgattttctcaacttaaccacacaagttattctgagttagcactgaaggcaagtcaacttttagaacaaactaaactaagtgaacttcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagattatatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcactggtcagaagagaatcattattatattgaagagccattattgcgtcacttggagcctccattatcgacatatcttgaactggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaattggtgatcttgttccatacacaacgagagtggatgtagattctgggacagaagattgcgtggttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtatatcgtgaactggaagatactggtttgcacaaggtgtatcatgctacctctacattgggtcctttgcatggcgtacctgtgaatacaccctttcagcctttaggattacttgatcagaagcgtcttttggcaaggaaaagcaatactacgtactgctacgactttgcactggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtggcggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtgaacaaactctcttttattttcccttag

SEQ ID NO: 45 - DNA, 6912 bp, Conyza canadensis
atgaattttcgggcatttgatctgaagctcaacatttttccgggcgattcaaataagcgttttactgttacaaaaagtttcgtctcaacgggtgaccactacacgacttctgataacaccaatccgaccagtcttacaaaggtgaaggtgaagaaacatgtgaagagggataaatttggagaaagaatggcatcactaaaacagatagtgtcaccctatggcaaggagtctagacttggaccattgtgttttagagaagaagggaatcgaacgcaaagtggcaccatgtcagaagctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaagtattttaattgcaaataatggaatggcggctgtaaagtttataagaagtgtgaggacatggagttatgaaacatttggctcagataaagctattttgctggtagccatggctacaccggaagatatgaggataaatgccgagcatattagaatcgctgatcagtttgttgaagtccctggtggtacaaataataataattatgcgaatgtgcaactcattgtagagactgctgagataacacatgttgatgctgtttggcctggttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcatgtaaaaattcctgtggatagctgtttggacacactcccggatgatgtatatagaaaagcgtgtgtgcatacaacagaagaagcaattgctagttgtcaagttgttggttatccagcaatgattaaggcatcatggggtggaggtggcaaaggcataagaaaggtgcataatgacgaagaagtcaaggcactttttaagcaagttcagggtgaagtgcctggttcccctattttcattatgaaagttgcttctcagagccgacatctagaagtgcagctactatgcgatcaacatgggaatgtagcagctttgcatagtcgtgattgcagtgttcaaaggcgacatcaaaagattattgaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggttgagcatccagtcacagagtggatagcggaaatcaatctacctgcagcacaagttgcggttggaatgggcattcctctttggcaaataccagaaataagacgattttatggaatggacaatagtggaggatacgatgcttggaggagaacatctgctcttgcaactccatttgactttgacaaggcagagtctatcagcccaaaaggtcattgtattgctgtacgtgtaacaagtgaggacccagatgatggatttaagcccactagtggaaaagttcaggagctaagttttaaaagcaagccaaatgtctgggcatacttttctgtcaagtccggaggaggcattcatgaattctcagattctcaatttggccacgtttttgcatttggcgagtcaagacctttggctattgcaaatatggttcttgggctgaaggaaattcaaattcgtggcgagatccgtacgaatgttgattatacaattgatctgttacatgctcctgattatagagaaaataaaatacataccggttggttagatagccgaattgctatgagggttagagcagaaaggcccccttggtatctttcagtagttgggggagcactttacaaagctgctgctagaagtgcagccatggtctcggactatgttggttaccttgaaaagggccaaatccctcctaagcatatatcattggtcaactcacaagtttctttgaatattgagggcagcaaatacacgattgatatggtaaaaagagggccaggaagttacagattgagaatgaatcaatccgagattgaagcagagatacatacactacgtgacggaggcttattgatgcagttggatgggaatagtcatatattatacgccgaggaagaagctgccggtactcgcttgcttattgatggacggacttgcttgcttcagaatgatcatgatccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggctggtgagcttatagcaaggctagatcttgacgatccgtcagctgtaagaaaagcagagcctttcaatggaaactttcctcttcttgggcctccaacggccatgtcagacaaagtgcatcagaagtgtgctgcaactttaaatgctgctcgaatgattctcgcaggctatgatcataacattgatgaattggaatccaagtttaaggagtacgaaggaatttccacacaacaaactattgactttcctgctagagttctacgggtcattcttgaaacccatcttggatcttgctcagaaaaagaaaagggagcccaagaaaggctcgttgagccattaatgggtcttgtaaagtcgtatgaagggggaagagaaagtcatgcacgtgggatcgttcatgctctatttgatgaatatttatctgttgaagagttgttcagcgacaacattcaggctgatgtaatcgaacgtcttcgacaactatacaagaaagatctcttgaggattgtcgacattgtcctttcccatcagggtgttaggagtaaaaacaaattgatactacggctgatggagcatttggtttaccccaatccggctgcgtatagggagaaactgatacgattttctcaacttaaccacacaagttattctgagttagcactgaaggcaagtcaacttttagaacaaactaaactaagtgaacttcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagattatatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcactggtcagaagagaatcattattatattgaagagccattattgcgtcacttggagcctccattatcgacatatcttgaactggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaattggtgatcttgttccatacacaacgagagtggatgtagattctgggacagaagattgcgtggttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtatatcgtgaactggaagatactggtttgcacaaggtgtatcatgctacctctacattgggtcctttgcatggcgtacctgtgaatacaccctttcagcctttaggattacttgatcagaagcgtcttttggcaaggaaaagcaatactacgtactgctacgactttgcactggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtggtggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtgaacaaactctcttttattttcccttag

SEQ ID NO: 46 - DNA, 6654 bp, Conyza canadensis
atgccagaagctcaaagaatgcctctaaatggaagccttaatcttggtaatggttatgtaaatggggccatttcattgaggtcttctgctagcagatctgccattgatgaattttgtaatgcacttggggggaataggccaatccatagtattttaattgcaaacaatggaatggctgctgtaaagtttataagaagtgtgaggacatggagttatgaaacgtttggttcagaaaaagcaattttgttggtagccatggctacacctgaggatatgaggattaatgccgagcatattagaattgctgatcagtttgttgaagtcccaggtggtacaaataataataattatgctaatgtgcagctcatcgtggagactgctgagataacacatgttgatgctgtttggcctggttggggtcatgcctctgaaattcctgaattacctgatgcattggacgcaaagggaattgtatttcttgggccgccggcttcatccatggcggctttaggagacaaaatcggctcttctttaattgcacaagctgctgacgtgccaacacttccttggagtggttctcatgtgaaaatttctgcagagagctgcttagacacaattccagatgacgtatatagaaaagcttgtgtccatacaaccgaggaagcagttgcttcttgtcaagttattggttatcctgctatgatcaaggcatcatggggcggtggtggcaaaggcataagaaaggtgcatagtgatgaagaagtcaagacactttttaagcaagttcagggtgaagtccctggttcccccatatttattatgaaagttgcttcccagagccgacatctagaagtacaactcctctgtgatcagcatggcaatgtagcggctttacatagtcgggattgcagtgttcaaaggcggcatcaaaagattatcgaggaggggccaataaccatagccccccctgacacaataaaaaaattggagcaagcggcaagaagattagccaaatcggtcaattatgttggagctgcaactgtagagtatttgtacagtatggaaaccggagattattactttttggagctcaatccccgtttacaggttgagcatcctgtcactgagtggatagcggaagttaatctacctgcagcacaagttgcggttggaatgggcattccactttggcaaattcccgaaataagacggttttatggaaaggaaaacggtggagggtatgatgcttggaggagaacatcggttcttgcaaccccatttgattttgatcgcgccgagtcagttaggccgaagggtcattgtgttgctgtacgtgtaacaagtgaagatccggatgatggttttaagcccaccagtggaaaagttcaggagctaagttttaaaagcaagccaaacgtatgggcatacttttctgtcaagtctggaggaggcattcatgaattctcagattctcaattcggtcatgtttttgcatttggagagtcaagaacattggctattgcaaatatggttcttgggctaaaggaaattcaaattcgtggcgaaatgcgcactaatgttgattatacaattgatttattacatgctccagattatagagaaaacaaaatacacacgggttggttagatagccgaattgcgatgcgggttagagcagaaaggcctccttggtatctttcggtagtggggggagctctttacaaagccgctgctagaagtgcagccatggcctctgactatgttggttatcttgaaaaggggcaaatccctccaaagcatttatcactagtcaactctcaagttactttgaatattgaggggagcagatacacaattgatatggtaaaaagaggacctggaggttatagattgaaaatgaaccaatctgagattgaagcagaaatacatactctacgtgacgggggtttattgatgcagttggatgggaatagtcatattatatatgctgaagaagaagccgctggtactcgtctcctcattgatggacggacatgtttgcttcagaatgatcatgatccttccaagctggtggccgaaacaccatgcaaacttctaagatacttagtctcagatagtagccatgtcgatgctgacacaccttatgctgaggtggaggtaatgaagatgtgtatgccgctactttcgccggcttctggagttatacagtttaagatgtctgaaggtcaagcaatgcatgctggtgagctaatagcaaggcttgatcttgatgacccatcagcagtaagaaaagcagagcctttccatggaacttttcctcttcttgggtcttcaactgccatgtcagataaagttcatcaaaagtgtgctacaactctaagtgccgctcgaatgattcttgcaggctatgatcacgatattgatgaattggaaacaaaatttaaggagtacgaaggaatttccacccaacaagctattgatttccccgccaaattattatggggaattcttgaaacacatcttgaattgtgctcggaaaaggaaaggggagcccaagaaaggcttgctgagccattaatgagtcttgtcaagtcctatgaaggtggcagagagagtcatgcacgtgggatcgttcatgctctttttgaagcatatttatctgttgaagagctatttagcgacaacattcaggctgatgtaattgaacgtcttagacaacaatacaagaaggatctgtcgagggttgttgacatcgtgatttcacatcagggtgttaagactaaaaacaaactgatactacgactgatggagcatttggtttaccctaatccagccgcctatagggaaaatctgatacggttttctcaattgaaccacactagttattctgagttagcattgaaggcaagtcagctgctagaacagactaaactgagtgaacttcgttcaagcatagctagaagtctttctgagttagagatgtttaccgaagaaggtgagaatatagatacccctaagaggaagagtgccattgatgaaagaatggaggatattgtgagtgctcctttggcggtcgaagatgcccttgttggtctttttgatcacagtgatcacacccttcaaaggcgtgttgttgagacctatgttcgaaggctatatcagccatatctcgtgaagaggagtgttaagatgcagtggcacagatccggacttattgcttcatggcaattcatggaaggacacgctgaagctgttaatgtgtctgattatgaaactattgatacacaattggtagataagaaatggggagctatggttattattagatctcttcaatttttacctgatgtcataagtgcagctcttaaagaaactacttataaacatcatggcacaagtcaaaatggggatgccaatccaagttatcaaggttatatgatgcatattgcattggtaggcatcaacaaccaaatgagtttgcttcaagacagtggtgatgaggatcaggctcaagagagagtcaacaagttagcaaaaatactcaaagataaagaaataagtgtgaaactaaaaaatgcaggatatgaagttgtaagttgcataatacaaagagacgaaggtagaggcccggtgagacactcatttcactggtcagaaaagaatcgttattatatcgaagagccatcattgcgtcatttggagcctccattatcgatttatcttgaactggacaagcttaagggctatgagaatgtaaagtacactccatcacgtgaccgtcaatggcacatgtatactgttgatgctaaaccacttccggttcaaagaatgtttcttagaacgcttgtaaggcacccgacaaaagaatggttcttgccctcaggataccaagattcggaagttgtggacccacggtctcagttaactttaccttttacatcaaggagcatcttgagatctttagtgaccgccatggaggagttggaacttcatgttcataatgctatagtcaagtcggaccatgctcatatgtacctctatatattgaaagaacaacaaataaatgatcttgttccatatactaagagagtggatgtagattctggtaaagaagaaggtgtggttgagacgcttttggtgaagttggtccgtgaacttcattcgatggttggggtaaagatgcaccggttaggtgtttttgagtgggaggtgaagctttgtatggtatcatctggtgaagccaacggtgtttggagggtggtggtcacaaatgtgactgggcatacctgcaatgtacatgtgtatcgggaagtagaagatactgttaaacacaaggcagtgtatcatgctccctctacattgggacctttacatggtgtgctggtgaacacaccctttcagcctctgggattactcgatcagaagcgtcttgtcgccaggaaaagcaatactacttactgctacgactttgcactggcatttgaagcagcccttgagaatatctggtcatcaaaactgcctggtgtaagcaggcccaagggcaaacttgtaaatgcgatggagcttgtgtttgctgaccgaagaggtttatggggcactccacttgtgccagtaacgcgcgagcctggacaaaataatgtgggaatggtagcgtggactatggacctctgcacaccagaatttcctgatggtaggacgattttagttgtttcaaatgacgtcacatttaaaaacggatcttttggtcctatcgaggatgcgttttttgaggcagtcactgagcttgcttgtgccaaaaaactgccgctcatttacctggcggcaaactcaggggcccgtatcggggtggccgaagaggtcagatccagctttagaattgggtggtctgatgagtcaactcccgactccggctttcagtatttgtatctaactcccgaagattactctcgtttggaatcatcagtaatagcacatgaaattcgtctatccagtggtgaaacaagatgggtcattgatactattgtcgggaaagaggatggattaggggttgagaatttgagtggtagtggggcgattgctggggctttttcgaaggcatataaagaaacttttactttaacctacgtgactggaagaactgttgggataggtgcatatctggcccgtcttgggatgcgatgcatacaaaggcttgatcaaccgattattttaactgggttttctgcactaaacaagcttttgggccgagaggtttatagttcgcagatgcaacttggtggacctaaaattatggccacgaatggcgttgttcatcaaactgtatctgatgatttggaaggtgtctcggctatcttgaactggttgagctatgttccgccttacgttggcggtccacttcctgttttgccacccatggatccaccagacaggcccgtcgagtacctgcctgaaaactcatgtgatcctagggcagccatttgtgggaccgtggatggtaacgggaaatgggttggtgggattttcgacagaaacagttttgtggagacgttggaaggttgggcaaggacagttgtaacaggtcgggcgaaactcggtggaatccctgtgggggttgttgctgtcgagacacaaacgatgatgcaagttatacctgcggatcctgggcagctcgattcacatgaacgtgtagttcctcaagctgggcaggtctggttcccggattctgctagtaagacagctcaagcgctgatggattttaatcgagaagagctcccccttttcattatggcaaactggcgagggttttcagccggtcaacgtgacctttttgaagggattctacaagcgggatcgacaattgtagagaatcttagaacctataaacagccagtttttgtctacattccaaaaacaggtgagcttcgaggtggtgcatgggtggtcgttgacagtcgaatcaattcagaccatatagaaatgtatgcagaaacaactgcgaaaggaaatgttcttgaacccgaaggtatgattgaaataaagttccgaaataaagagctggtagactgcatgggtcgattggacccactaatttgcaatctaaaagaaaaacttaaagaaacgaagctcgatcaagcaatcacccagcagataaaagcccgtgagaaacagcttttaccaatttacactcaaatcgctacaaagtttgctgaacttcatgacacatcattccgaatggctgaaaaaggtgttgtcaaaaaggttgttgactgggcaatttcccggtttttcttctacaaaagactccagcgtaggctggccgaggcttctctaatcaagagtgctcgtgatgctgctggtgacacgctttcacacaaatctgctcatgaaatgatcaaaaaatggtttttggacacaaaaagtgaagatatgtgggtgaatgacgacgcctttttcacatggaaagatgatccattgaactatactagcaaattagccgatctacgtacacagaagatatcaaatcagttattaaagattggcagttcaccttccgatctgcaagctttaccacagggactcgctgcacttttgcaagaggtgaatcctgcagccaaaaataaattgattgaagaactcaggcggataattgagtag

SEQ ID NO: 47 - DNA, 4804 bp, Conyza canadensis
ctactttcgccggcttctggagttatacagtttaagatgtctgaaggtcaagcaatgcatgctggtgagctaatagcaaggcttgatcttgatgacccatcagcagtaagaaaagcagagcctttccatggaacttttcctcttcttgggtcttcaactgccatgtcagataaagttcatcaaaagtgtgctacaactctaagtgccgctcgaatgattcttgcaggctatgatcacgatattgatgaagttgtcaaaaaccttcttcgttgtctagataatcccaagctacctttcctccagtggcaagaatgctttgcagttctagccaatcgtctccctaaagatctaagaaacaagttggaatccaagtttaaggagtacgaaggaatttccacacaacaaactattgactttcctgctagagttctacgggtcattcttgaaacccatcttggatcttgctcagaaaaagaaaagggagcccaagaaaggctcgttgagccattaatgggtcttgtaaagtcatatgaagggggaagagaaagtcatgcacgtgggatcgttcatgctctatttgatgaatatttatctgttgaagagttgttcagcgacaacattcaggctgatgtaatcgaacgtcttcgacaactatacaagaaagatctcttgaggattgtcgacattgtcctttcccatcagggtgttaggagtaaaaacaaattgatactacggctgatggagcatttggtttaccccaatccggctgcgtatagggagaaactgatacgattttctcaacttaaccacacaagttattctgagttagcactgaaggcaagtcaacttttagaacaaactaaactaagtgaacttcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagattatatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcactggtcagaagagaatcattattatattgaagagccattattgcgtcacttggagcctccattatcgacatatcttgaactggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaattggtgatcttgttccatacacaacgagagtggatgtagattctgggacagaagattgcgtggttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtatatcgtgaactggaagatactggtttgcacaaggtgtatcatgctacctctacattgggtcctttgcatggcgtacctgtgaatacaccctttcagcctttaggattacttgatcagaagcgtcttttggcaaggaaaagcaatactacgtactgctacgactttgcactggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtggcggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtggatccagtgaccaaaaataaactagtcgaagaactcttgcgcgtaattaagtaggtaattatacacaaagctcatcagattctttctttgtttgtcaaagtgagaagccttttgagcagtgtacattataagtaggtgtcataagaaaacaggctcaaaatagtttaaagtatatgaggtttaccatgttcagattgttttatttttcttcataaattgtataataccatcacatttctatcgcattttttatatatctatatataaatggtca

SEQ ID NO: 48 - DNA, 454 bp, Conyza canadensis
ggtcattgtgttgctgtacgtgtaacaagtgaagatccggatgatggttttaagcccaccagtggaaaagttcaggagctaagttttaaaagcaagccaaacgtatgggcatacttttctgtcaagtctggaggaggcattcatgaattctcagattctcaattcggtcatgtttttgcatttggagagtcaagaacattggctattgcaaatatggttcttgggctaaaggaaattcaaattcgtggcgagatgcgcactaatgttgattatacaattgatttattacatgctccagattatagagaaaacaaaatacacataccggttggttagatagccgaattgctatgagggttagagcagaaaggcccccttggtatctttcagtagttgggggagcactttataaagctgctgctagaagtgcagccatggtctcggactatgttgg

SEQ ID NO: 49 - DNA, 19367 bp, Conyza canadensis
  unsure (1)..(19367): unsure at all n locations
tttggtggtggtttcgtggtctaattcgaagaaacgagtgagatatcggtattttaagttttccggcgaactttccgatgaaagttagccggagaagatgaagatgatgacaacagaaaattaaatttcattttttgtccctgaacttgtcacttttcgcactttaagtccctcacgtgttttgcacgtgtgggacttaacggctgaaacttaacaccgtttggcgagggacgtcgattgcaaaaatctgtcaagtttagggtcaaaattgtaattttttcattttagggatgaaaagtgaaaaacgcgccaagtttagggacgaaaaatgtaatttactctaagtattatgtaatttgttttgttattaataaaacatataaattaaaaaaaggttagttatttaaagtttataaatgttaaggataaattattaaaanntgaagaaaaggttgggagttttggttgccactagaaaaaggttgaaaaaaaggttggagggttgaaatgaggtggagtaatttgattgggtatttaaagggagatgagagggttgaaccctcggctccgtccccccttataggacaccttgttcatgaggatactttgatattttaatggggaaatgataaattcttttaaattaacctaaaaatcattctaaaactataagaagatgatatgtgatatctactaattctcttctctactctcgcccttttttcacatataatcatctcattattaagaacatttttaggttatttagttaaaagaatgaatcatttctcattttaatataaatggttaatttgaattgacatcaatcactggcgagaaacacaaaggtaaaagagtagtgaacacgaaggtaaaagagtagtaaattaccaatcatatccttcctcctttatattttgatggaacaaacacaaatttattttagaattttttaaaaaaatatattaaaccgggtagaacataatcattattattgttacacgaaatttattgtacaccgtgttagctggttacagtagtattaattaattggtcaaatatatgtgcattaaaatcaggaacacatttataacaaacatagcgagattttaggagaactttaattgaaaattttaccattacagtaattaattaacttaaacacatacaaaaccctatacattatttacattgtctacatttcattactgttgttggtttctgatcgaatgccatgaattttcgggcatttgatctgaagctcaacatttttctgggcgattcaaataagcgttttactgttacaaaaagtttcgtctcaacgggtgaccactacacgacttctgataacaccaatccgaccagtcttacaaaggtgaaggtgagcgtcaatatttagtttaatctcatcgtctgtgttttaagcttttttgaggtctaaacctttttggtcagcaaaatttgaaaattcttttaatatgttaacttcttttggaagctttagagatttatatattcttaatccataataatctataattctatatttctttactcctctataaagcatattgctttttttatttttggaaattaagcattttttaaaatattttcataatacccttacacccctaccttctttctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttttggtatcgatcgttgtgtagtgttgcacacctcacttgatattagttttatgtgattatatatggttaatttaatttttctttgatttttgatcatggtcttaaatattattaaaggtgaagaaacatgtgaagagggataaatttggagaaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtatacatacattatacatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcttacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgtaatttctttgaaatttataagtttcttgcaatgggtatatgattttctattaattgaagtggttaataacaggatttggtgagtaaagtttgaatctttcgagttatggatttatgtcataccttttcttgcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatttgatgagttcaataataataagaaatttagaactttgaacctcgtatttctaattcgaggtttcctagctctatgtaaaccccactatattctccattataacatacgtttatgtgttactttatttagacattttaatatttgactcaattataacataggttcagctgaaaatttaatttctttgttagtgaattgttgtgacttttttttttggtagtttgcgttgtgatagtcaggagacagaaagggcaatttgtttctgttctttttaagttagataggtgaccatttcggtagatactagatagtgcaaagatatagtgttttttgtaagtaccaagtactttatgaacttacccaatgataacaacttttgatggttcagtggttcagccttctctttgtccctagactaattagtccaatctatctctcagtatatattttttaggtattgacatattttatgatattggcaagttggtagtttactttcaacttttaagcaatatatggacatatccacatatatcagttccatattactagcatgtatcctattctgggttagtatgctacaaaaagggtttacatgtcaaatgcagaattgttcaaagaaaacgagttgttagacctaataagtcaaagtaatgcttactctacactttgcttactgtttggcagtggcaccatgtcagaagctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaagtattttaattgcaaataatggaatggcggctgtaaagtttataagaagtgtgaggacatggagttatgaaacatttggctcagataaagctattttgctggtagccatggctacaccggaagatatgaggataaatgccgagcatattagaatcgctgatcagtttgttgaagtccctggtggtacaaataataataattatgcgaatgtgcaactcattgtagaggtatgtagcttatatacgtggatcctacatcatgatttataagctttaaaatgatctattttatgaaacattgtgcatttaatgatgcctgaaaagattatgtttccaagacttattttgcttaacttgttggatcaaaatgttgatctgcttccatgaatatagtaattcgaatatgttggtttaatcttcactttcaaaaaaaaaaaaaaatacttctttttatgttagcatttgagtttgaatctcaagagaacttatttcacttttgaaatcgatatggatgtgttgaacatgtaattgataatcagcaacattttaaaatttattagaaaatgacgagggatgcctcttcaggctacgcggcgagcctttggctctaatgtaagcggcctaaccggtatacccgggtctcttctgagatctttgggtcaccttaccactagacccccttggagaaggttttaaaaagtattagaaagtatataaatataaaatagaaacgatatgtaaaattttaaaaatatgtttcattgagttatcttacacctgactatttgatattgagcattaatacgagtttgatggaaaatataaaataattaatatttagctatcatcatcaattcctttaaaatggttcatttatgatttatgacttcagactgctgagataacacatgttgatgctgtttggcctggttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcatgtaagattttttttactattgtagtctttgtcacatcaacaatgatccttatacttttaactccataaagattgcatcgttctatctcatattctctataatctaaaaaaattctatattcctcttatttgtgaaaagtctgaacttcataacaaaatcacatcttgtacctcttatatattaaactgcatctttatgcctctaatttattggaaacaagatctttaaatcctttaaaggttgcatctttatacctcttattctgtagaaattacatttcataccacttgttctttgcaatttcgcatagatattaatgcctactctttaaaagatacttttctacttctttacctctataatcacatctttgtacctttcacctctccagtcttcttactctctacagtcacatttttaggtaaaaattcctgtggatagctgtttggacacactcccggatgatgtatatagaaaagcgtgtgtgcatacaacagaagaagcaattgctagttgtcaagttgttggttatccagcaatgattaaggcatcatggggtggaggtggcaaaggcataagaaaggtttgattctttacaattgggaaattatttcttctcctcaaagtatacggcaaacttttaaaaccaattacctattgaaactttaggtgcataatgacgaagaagtcaaggcactttttaagcaagttcagggtgaagtgcctggttcccctattttcattatgaaagttgcttctcaggtaggacaatgttgtaattgttattattttcccaatttcaactcaaaacccattatcattataataatatgttgatttcttgtatatacagagccgacatctagaagtgcagctactatgcgatcaacatgggaatgtagcagctttgcatagtcgtgattgcagtgttcaaaggcgacatcaaaaggtaagttcatgtttgtcctttttactttctttttatcctgttttgtaactctaattttatttaatacttgatatgtcaagattattgaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggtgcttgcaatttctgttttgtgggtcctagttatgtgtcctaagaagtaagatgaaatggtgggctccaagatggttatgatttgttttctgaagctatgtatgtggaacctttctttaggttgagcatccagtcacagagtggatagcggaaatcaatctacctgcagcacaagttgcggttggaatgggcattcctctttggcaaataccaggttagatatcaaaagttcgttttttgttgactatcatagttggtcttttgctacaatgcaaccatcatgtcaactattttcttaattgctctacatgtcttgttggcttagaaataagacgattttatggaatggacaatagtggaggatacgatgcttggaggagaacatctgctcttgcaactccatttgactttgacaaggcagagtctatcagcccaaaaggtcattgtattgctgtacgtgtaacaagtgaggacccagatgatggatttaagcccactagtggaaaagttcaggtttggaagcagactaacatataccatatacccctacaaatataatatatatccttttttttttttttttaccatattgatcgaattccacttttaggagctaagttttaaaagcaagccaaatgtctgggcatacttttctgtcaaggtacgctgggttcaaacctttttttttttttttgaacttccaattgacatattctaaaatgtttgaacattgcagtccggaggaggcattcatgaattctcagattctcaatttggtaaagacgactggatcttgtttggttgaaatatcttgaatactcacttattggtgtagttcaagtttacattcttggtcaaaacgttcatgttctcattttaattctgtatctatcttaggccacgtttttgcatttggcgagtcaagacctttggctattgcaaatatggttcttgggctgaaggaaattcaaattcgtggcgagatccgtacgaatgttgattatacaattgatctgttacatgtgagcattttggggtttcacagctaacaaatttcttattttgtttaccataatgagttacttcatggcgatataaggggtgagccatggagcaagtgccatgtatcttaacagataaattgttatgttcatgtttggcgagtacttacacatttgagaatgtcgagaatttgattatatttcaccaaacgttcttattgcttcacctaaaatgtgaacgttttcttacatgcttagtttttattcctttttctatacttgtaggctcctgattatagagaaaataaaatacataccggttggttagatagccgaattgctatgagggttagagcagaaaggcccccttggtatctttcagtagttgggggagcactttatgtaagtacaaaatacctctttctttctatattcgtcatttttaaagtacttttacttaccattgatgtttgttaacttcagaaagctgctgctagaagtgcagccatggtctcggactatgttggttaccttgaaaagggccaaatccctcctaaggtttgtcagatattttagtatttttttttaatttttaagagttggttctcgtaatgtttacattgatgatcagtatttgtctgttttcttactttcagcatatatcattggtcaactcacaagtttctttgaatattgagggcagcaaatacacggtaaataacaagataactgcctatcgttattcgttcataaaaatggttgttcttgaagttttcttttgtgtgttttttttcttctgatttttttctttttatttgttagattgatatggtaaaaagagggccaggaagttacagattgagaatgaatcaatccgagattgaagcagagatacatacactacgtgacggaggcttattgatgcaggtacttaatccatacgctctatttttctttctatttggtttattctgtcaaattttctttttatttggtttattctgtcaaaatttctttttatttggtttattccgtagttagtttgtgattaactgattactatattaagtcattggttggtatgtatacatataaaactcgaatataagcattttaatgatgccaaacctatatgtagttttactctttaggatttcatgatatacctaggaaatccctcgtgtctttgtggcagctagcaagttgaagattaataatatcaataaagaaattcagagaatttaatgcagcatgttctaagggagtgttcggggatgcattctgaaaataattatgtgatatttagtaaaattgcaattaaacgtggtgcaagaaatagtgtttggatatgcttctgctataaagttctggcaatcgctgtattgagtgtttgacggattatgtctatttaagaaggtggtagataaactaaaagtatacatggttagtggtgctgtaagcatttgccatcaaaaagtaggtagataaaggaagagtgctataagtagttttatgctactttttggttatcgagttcgttgcagctagtatcaaactaattctttaactatcgtagctgtaataggtcaccctgaacatttcaatttattgcaaccttaagttacatcatttgataatcatgttcaagacacattcttattttatactctgatatcatatgatttgtggttggttgattcaatgatgtagttggatgggaatagtcatatattatacgccgaggaagaagctgccggtactcgcttgcttattgatggacggacttgcttgcttcaggtgcgaacaactagttcttttcttgaactttatttagaggttgccatttcaaccatttatctatgatgggacaatttaaacaatgttttacccttaatggtgtattcaaatgggtcaacagtgacccaaagtacattctcactggagcaaactgcctgtatcatttttttttgtgaggttcattgtttttgaataatattgtgttaattttcatatttagtagactaaagtaattatgtaagttgttgtgaacccgttcgatctgctcaggttatactcgaccggttgcaatcctcctaatttgccacctttactattacttactatttgggttacctgtttatagaatgatcatgatccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggttagcatgtcactttttccccatttttaagaagtatttacattgttcagtttttccgaacatccaagaataaagctcttggttctatgtttttgccaactacttacagctatttatatttacatgttaataaaatgttctatcgattgacttcttgagtcattgtgcttatcgcaactcaatcttcgttattgtacagtgattttttaaatgtaatactgccaactttttgaataaatcgtatcaaatgtaatctttaagctatataacaaacatatgaatttcgatttccaaataatatctacagttcacaaacaaatgcttgtttcctgtttgttaataccatttttgtcttctctaaatcatacataccaaaaccaaaattgttgatcatttctgatgaatataaatctttgtatatgtaggctggtgagcttatagcaaggctagatcttgacgatccgtcagctgtaagaaaagcagagcctttcaatggaaactttcctcttcttgggcctccaacggccatgtcagacaaagtgcatcagaagtgtgctgcaactttaaatgctgctcgaatgattctcgcaggctatgatcataacattgatgaagtaacttgtttgccatttactgatttcaaattttctgaaagattattctgttaacagttctgatctttgatcgtaggttgtgcaaaacttgcttcgttgtcttgatagtcccgagcttcctttccttcagtggcaagaatgctttgcagttctagcaaatcgtctccctaaagatctaagaaacaaggcaaattgatattttacccttttttttttcttttcaagcagttaacattgggattatttttctaaattcaatatgttttgtatattcagttggaatccaagtttaaggagtacgaaggaatttccacacaacaaactattgactttcctgctagagttctacgggtcattcttgaagttagttgtgatcagtagttttctttataagtcctttctttgatttaaagacataatttagttatatgttacctttgtaatgttttcgttcagacccatcttggatcttgctcagaaaaagaaaagggagcccaagaaaggctcgttgagccattaatgggtcttgtaaagtcatatgaagggggaagagaaagtcatgcacgtgggatcgttcatgctctatttgatgaatatttatctgttgaagagttgttcagcgacaacattcaggtgcgtttgttaggatcgccgatccagtattttggattttcgatagggcatgcacttgcattaccatagtcagtttatattttatttcatcttgttacacgacaacaaagtaccttttttcaaagtataaaactgcacaggttatgtgctcccaaagggttttttaatactttgatctatgtggaaatggtataagagttttaatcattttgacattaatgtctggataaatttgttacgggttaaaccaatcaatctaagccaaaccaaaagttacctgcaaaagctattacctaacccacccattttgccacctctgttggttttctttaggtctactaatggttatcgagtaaattatattataacataagtagtaaaccaaaatcctgtaccttttaggctgatgtaatcgaacgtcttcgacaactatacaagaaagatctcttgaggattgtcgacattgtcctttcccatcaggtacacatgttttttggtttttgttctcccctttaatgtgtattttataccgatcattaatatatgtccatgcagggtgttaggagtaaaaacaaattgatactacggctgatggagcatttggtttaccccaatccggctgcgtatagggagaaactgatacgattttctcaacttaaccacacaagttattctgaggtcatcatcgtcatatatatacactgttacaattttgatcatctcaatcacttttctgttagtactgagtttatgttaattgattattattaatagttagcactgaaggcaagtcaacttttagaacaaactaaactaagtgaacttcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagattatatcaggtttttacctttcatttctgcatcaacagagttgtcaatttgttgtcatagaaaattgaaggtgtttgatcagattgttttaaataaaatgtggtttaatatatgcatacatctttaaaaaaagaaacgacatgtatttattggtaaaaaactaaaacatcaaatcaagtgtggattttatactgttttttacaaaactttgtaaactgattatatgttgtttacttgaacagataaatgttttaaactattaagaatatttaaaagatggaataagaataaatttaaagtcatttctgagttgtggcccttgagaatagctgttcatgtagttagtagacctatttgacttttttctaaaatgtatactacactgtttattaatgcctactcaaatgaatcgggttgtctaaaataaaacatcacttataacaacaataaaagaagcaaagcagtcattttagtttgcacttttgcaattctcttggtaggaagaaatctaatatgattttaactgaccatgcttctcatatctgtatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacaggtatgtgatgataatgttacatgaaaagataccatcaaacctgctttatgatctttgtgtcatgctcaagaaacaaaataactggataaatataaaaactgagacccatcatcattcgatgatgcatgccatgttaacagtcggtagatttgatggcttattcattagctggtgacatatatttgccctgttgatgttatgttcacttgttatgtgatgaactgtagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcactggtcagaagagaatcattattatattgaagagccattattgcgtcacttggagcctccattatcgacatatcttgaactggtttgtgctcaaaagacccttcataatttttcaattcattaataatattataatactaatgaagttgtaaatgtattgcttatgcaggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaattggtgatcttgttccatacacaacgtaagtattcatgtcatcttcatgaatttttttttatcatatgcactcatttaacaatggtaatatgttgtgaacaggagagtggatgtagattctgggacagaagattgcgtggttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtaagtcattagataggattatagacatttcagcaatacccctcaaacatgcttttacctaaagtcaattgctgcaattttgatttaggtatatcgtgaactggaagatactggtttgcacaaggtgtatcatgctacctctacattgggtcctttgcatggcgtacctgtgaatacaccctttcagcctttaggattacttgatcagaagcgtcttttggcaaggaaaagcaatactacgtactgctacgactttgcactggtataactatcattttgctctttcaatgcttgatggtcacctaaatttgattgtacagaaacacttattaccatatctatatttccaggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtggcggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtgaacaaactctcttttattttcccttagaactatttaatttaattatctatgaatgcgcaaaaacaacagttttatttaaatatttttctttcactatgctgcaggtggatccagtgaccaaaaataaactagtcgaagaactcttgcgcgtaattaagtaggtaattatacacaaagctcatcagattctttctttgtttgtcaaagtgagaagccttttgagcagtgtacattataagtaggtgtcataagaaaacaggctcaaaatagtttaaagtatatgaggtttaccatgttcagattgttttatttttcttcataaattgtataataccatcacatttctatcgcattttttatatatctatatataaatggtcattttttattttattttatttttataaaaggttctctttgaccatctttgtgtttccttttggctcttcttgtccatcttcagttcttctccttccttcgctttcttttcgtctcttgagttatcttttctttatcttctcatcgtgtacggattacgttgatatgagcacatatggcaaagttgattcagataactccacaacaaattttcacttgatttttgaatgtttataagcttacaatacatccatgcactcatgttcatctgctaaatgtactagtacataatcaagttaaaaacttcaacccaagaacactattccactaaaaatttcggcatgatctcatcataaaatctacaatcattgtttattgtcaaccatcaaagacctgtagaatactaatgaacaattgcaacaagtgaacagtttgccccttgttaccgttgaatgaatatttcaaagatcatgatcgagcctcgatcttgaccagcactgaaacattataaaaacaacttccattttaaatgtttgtctaatatagggaagtgagagtcaggtagcccacaatgttttagaccccagagctacttgttctggctgtggggttaaatatagttatatagacttatgttaagtgcaggcattacacacttttttgcattatatgtttacgcgcagatatatgtatttgtgaccagttaaaccggtgtgcttctcttttctgtgtaatgagctctgttatgcagtttcgggtttgagtcgctttgtgataattttgtatgtgttactggcccggccagataaatgatcggttgatataggctggttctagtcacactagacgctgattagtggttaggcttcgatgtataaatcaaagttatagctacattcaaatcattattataattatttctatttcattcaaagtaggaagattatatcatacataaatatgacacacaggatgaatttcataaacttcaattctacttttcattaaaagcttaatttatctagttgcccggtttcccattcttcttcccgttgccgccaccaggccttttactccaccatggccaccccctccttccccaaccaccaaatggatatccaccccagatacctggccatccaccacctggccaaaatccgccaccaggaaaatatccaccacctggccaataacccccataatacggatatgatgggtcatagccccctccatatcctttacctcttcctggtccaccgtaccctccatatccatcacccgaatcataacctccccctccaccatatctgccaccatgatcttttccacgtccttcatcataaccaccatcttctccaccatgatcttttccacgtccttcatcgtcgtcccctttgccttcatgatcaccatcttcaccaccatgatcttctccaggttcatcatcatcatggtcatcgccttttcccccttcatcaccatgatctcttcctggtccatcttgtccaccaccttcatgatcaccaccttcatcaccatgatcttgtccaggtccatcatcatcatggtcaccaccttttcccccttcgccaccatgatctcttcctggtccatcttgtccgccaccttcatgatcaccgccttcacca

SEQ ID NO: 50 - DNA, 17803 bp, Conyza canadensis
cataatactcttacacccctaccttctttctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttttggtatcgatcgttgtgtagtgttgcacacctcacttgatattagttttatgtgattatatatggttaatttaatttttctttgatttttgatcatggtcttaaatatcattaaaggtgaagaaacatgtgaagagggataaatttggagaaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtatacatacattatatatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcgtacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgtaatttctttgaaatttataagtttcttgcaatgggtatatgattttctattgattgaagtggttaataacaggatttggtgagtaaagtttgaatctttcgagttatggatttatgtcataccttttcttgcccttcaaaataaagtcaaagctttagttttgtgatttgactttggtatcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatttgatgagttcaataataataagaaatttagaactttgaacctcgtagttctaattcgaggtttcctagctctatgtaaaccccactatattctccattataacatacgtttatgtgttactttatttagacattttaatattgactcaattataacataggttcagctgaaaatttaatttctttgttagtgaattgttgtgacttttttttttggtagtttgcgttgtgatagtcaggagacagaaagggcaatttgtttctgttctttttaagttagataggtgaccatttcggtagatactagatagtgcaaagatatagtgttttttgtaagtaccaagtactttatgaacttacccaatgataacaacttttgatggttcagtggttcagccttctctttgtccctagactaattagtccaatctatctctcagtatatattttttaggtattgacatattttatgatattggcaagttggtagtttactttcaacttttaagcaatatatggacatatccacatatatcagttccatattactagcatgtatcctattctgggttagtatgctacaaaaagggtttacatgtcaaatgcagaattgttcaaagaaaacgagttgttagacctaataagtcaaagtaatgcttactctacactttgcttactgtttggcagtggcaccatgtcagaagctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaagtattttaattgcaaataatggaatggcggctgtaaagtttataagaagtgtgaggacatggagttatgaaacatttggctcagataaagctattttgctggtagccatggctacaccggaagatatgaggataaatgccgagcatattagaatcgctgatcagtttgttgaagtccctggtggtacaaataataataattatgcgaatgtgcaactcattgtagaggtatgtagcttatatacgtggatcctacatcatgatttataagctttaaaatgatctattttatgaaacattgtgcatttaatgatgcctgaaaagattatgtttccaagacttattttgcttaacttgttggatcaaaatgttgatctgcttccatgaatatagtaattcgaatatgttggtttaatcttcactttcaaaaaaaaaaaaaaatactttcaactttttatgttagcattgagtttgaatctcaagagaacttatttcacttttgaaatcgatatggatgtgttgaacatgtaattgataatcagcaacattttaaaatttattagaaaatgacgagggatgcctcttcaggctacgcggcgagcctttggctctaatgtaagcggcctaaccggtatacccgggtctcttctgagatctttgggtcaccttaccactagacccccttggagaaggttttaaaaagtattagaaagtatataaatataaaatagaaacgatatgtaaaatttaaaaaatatgtttcattgagttatcttacacctgactatttgatattgagcattaatacgagtttgatggaaaatataaaataattaatatttagctatcatcatcaattcctttaaaatggttcatttatgatttatgacttcagactgctgagataacacatgttgatgctgtttggcctggttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcatgtaagattttttttactattgtagtctttgtcacatcaacaatgatccttatacttttaactccataaagattgcatcgttctatctcatattctctataatctaaaaaaattctatattcctcttatttgtgaaaagtctgaacttcataacaaaatcacatcttgtacctcttatatattaaactgcatctttatgcctctaatttattggaaacaagatctttaaatcctttaaaggttgcatctttatacctcttattctgtagaaattacatttcataccacttgttctttgcaatttcgcatagatattaatgcctactctttaaaagatacattttctacttctttacctctataatcacatctttgtacctttcacctctccagtcttcttactctctacagtcacatttttaggtaaaaattcctgtggatagctgtttggacacactcccggatgatgtatatagaaaagcgtgtgtgcatacaacagaagaagcaattgctagttgtcaagttgttggttatccagcaatgattaaggcatcatggggtggaggtggcaaaggcataagaaaggtttgattctttacaattgggaaattatttcttctcctcaaagtatacggcaaacttttaaaaccaattacctattgaaactttaggtgcataatgacgaagaagtcaaggcactttttaagcaagttcagggtgaagtgcctggttcccctattttcattatgaaagttgcttctcaggtaggacaatgttgtaattgttattattttcccaatttcaactcaaaacccattatcattataataatatgttgatttcttgtatatacagagccgacatctagaagtgcagctactatgcgatcaacatgggaatgtagcagctttgcatagtcgtgattgcagtgttcaaaggcgacatcaaaaggtaagttcatgtttgtcctttttactttctttttatcctgttttgtaactctaattttatttaatacttgatatgtcaagattattgaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggtgcttgcaatttctgttttgtgggtcctagttatgtgtcctaagaagtaagatgaaatggtgggctccaagatggttatgatttgttttctgaagctatgtatgtggaacctttctttaggttgagcatccagtcacagagtggatagcggaaatcaatctacctgcagcacaagttgcggttggaatgggcattcctctttggcaaataccaggttagatatcaaaagttcgttttttgttgactatcatagttggtcttttgctacaatgcaaccatcatgtcaactattttcttaatttctctacatgtcttgttggcttagaaataagacgattttatggaatggacaatagtggaggatacgatgcttggaggagaacatctgctcttgcaactccatttgactttgacaaggcagagtctatcagcccaaaaggtcattgtattgctgtacgtgtaacaagtgaggacccagatgatggatttaagcccactagtggaaaagttcaggtttggaagcagactaacatataccatatacccctacaaatataatatatatccttttttttttttttttaccatattgatcgaattccacttttaggagctaagttttaaaagcaagccaaatgtctgggcatacttttctgtcaaggtacgctgggttcaaacctttttttttttttttgaacttccaattgacatattctaaaatgtttgaacattgcagtccggaggaggcattcatgaattctcagattctcaatttggtaaagacgactggatcttgtttggttgaaatatcttgaatactcacttattggtgtagttcaagtttacattcttggtcaaaacgttcatgttctcattttaattctgtatctatcttaggccacgtttttgcatttggcgagtcaagacctttggctattgcaaatatggttcttgggctgaaggaaattcaaattcgtggcgagatccgtacgaatgttgattatacaattgatctgttacatgtgagcattttggggtttcacagctaacaaatttcttattttgtttaccataatgagttacttcatggcgatataaggggtgagccatggagcaagtgccatgtatcttaacagataaattgttatgttcatgtttggcgagtacttacacatttgagaatgtcgagaatttgattatatttcaccaaacgttcttattgcttcacctaaaatgtgaacgttttcttacatgcttagtttttattcctttttctatacttgtaggctcctgattatagagaaaataaaatacataccggttggttagatagccgaattgctatgagggttagagcagaaaggcccccttggtatctttcagtagttgggggagcactttacgtaagtacaaaatacctctttctttctatattcgtcatttttaaagtacttttacttaccattgatgtttgttaacttcagaaagctgctgctagaagtgcagccatggtctcggactatgttggttaccttgaaaagggccaaatccctcctaaggtttgtcagatattttagtatttttttttaatttttaagagttggttctcgtaatgtttacattgatgatcagtatttgtctgttttcttactttcagcatatatcattggtcaactcacaagtttctttgaatattgagggcagcaaatacacggtaaataacaagataactgcctatcgttattcgttcataaaaatggttgttcttgaagttttcttttgtgtgttttttttcttctgatttttttctttttatttgttagattgatatggtaaaaagagggccaggaagttacagattgagaatgaatcaatccgagattgaagcagagatacatacactacgtgacggaggcttattgatgcaggtacttaatccatacgctctatttttctttctatttggtttattctgtcaaattttctttttatttggtttattctgtcaaaatttctttttatttggtttattccgtagttagtttgtgattaactgattactatattaagtcattggttggtatgtatacatataaaactcgaatataagcattttaatgatgccaaacctatatgtagttttactctttaggatttcatgatatacctaggaaatccctcgtgtctttgtggcagctagcaagttgaagattaataatatcaataaagaaattcagagaatttaatgcagcatgttctaagggagtgttcggggatgcattctgaaaataattatgtgatatttagtaaaattgcaattaaacgtggtgcaagaaatagtgtttggatatgcttctgctataaagttctggcaatcgctgtattgagtgtttgacggattatgtctatttaagaaggtggtagataaactaaaagtatacatggttagtggtgctgtaagcatttgccatcaaaaagtaggtagataaaggaagagtgctataggtagttttatgctactttttggttatcgagttcgttgcagctagtatcaaactaattctttaactatcgtagctgtaataggtcaccctgaacatttcaatttattgcaaccttaagttacatcatttgataatcacgttcaagacacattcttattttatactctgatatcatatgatttgtggttggttgattcaatgatgtagttggatgggaatagtcatatattatacgccgaggaagaagctgccggtactcgcttgcttattgatggacggacttgcttgcttcaggtgcgaacaactagttcttttcttgaactttatttagaggttgccatttcaaccatttatctatgatgggacaatttaaacaatgttttacccttaatggtgtattcaaatgggtcaacagtgacccaaagtacattctcactggagcaaactgcctgtatcatttttttttgtgaggttcattgtttttgaataatattgtgttaattttcatatttagtagactaaagtaattatgtaagttgttgtgaacccgttcgatctgctcaggttatactcaaccggttgcaatcctcctaatttgccacctttactattacttactatttgggttacctgtttatagaatgatcatgatccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggttagcatgtcactttttccccatttttaagaagtatttacattgttcagtttttccgaacatccaagaataaagctcttggttctatgtttttgccaactacttacagctatttatatttacatgttaataaaatgttctatcgattgacttcttgagtcattgtgcttatcgcaactcaatcttcgttattgtacagtgattttttaaatgtaatactgccaactttttgaataaatcgtatcaaatgtaatctttaagctatataacaaacatatgaatttcgatttccaaataatatctacagttcacaaacaaatgcttgtttcctgcttgttaataccatttttgtcttctctaaatcatacataccaaaaccaaaattgttgatcatttctgatgaatataaatctttgtatatgtaggctggtgagcttatagcaaggctagatcttgacgatccgtcagctgtaagaaaagcagagcctttcaatggaaactttcctcttcttgggcctccaacggccatgtcagacaaagtgcatcagaagtgtgctgcaactttaaatgctgctcgaatgattctcgcaggctatgatcataacattgatgaagtaacttgtttgccatttactgatttcaaattttctgaaagattattctgttaacagttctgatctttgatcgtaggttgtgcaaaacttgcttcgttgtcttgatagtcccgagcttcctttccttcagtggcaagaatgctttgcagttctagcaaatcgtctccctaaagatctaagaaacaaggcaaattgatattttacccttttttttttcttttcaagcagttaacattgggattatttttctaaattcaatatgttttgtatattcagttggaatccaagtttaaggagtacgaaggaatttccacacaacaaactattgactttcctgctagagttctacgggtcattcttgaagttagttgtgatcagtagttttctttataagtcctttctttgatttaaagacataatttagttatatgttacctttgtaatgttttcgttcagacccatcttggatcttgctcagaaaaagaaaagggagcccaagaaaggctcgttgagccattaatgggtcttgtaaagtcgtatgaagggggaagagaaagtcatgcacgtgggatcgttcatgctctatttgatgaatatttatctgttgaagagttgttcagcgacaacattcaggtgcgtttgttaggatcgccgatccagtattttggattttcgatagggcatgcacttgcattaccatagtcagtttatattttatttcatcttgttacacgacaacaaagtaccttttttcaaagtataaaactgcacaggttatgtgctcccaaagggttttttaatactttgatctatgtggaaatggtataagagttttaatcattttgacattaatgtctggataaatttgttacgggttaaaccaatcaatctaagccaaaccaaaagttacctgcaaaagctattacctaacccacccattttgccacctctgttggttttctttaggtctactaatggttatcgagtaaattatattataacataagtagtaaaccaaaatcctgtaccttttaggctgatgtaatcgaacgtcttcgacaactatacaagaaagatctcttgaggattgtcgacattgtcctttcccatcaggtacacatgttttttggtttttgttctcccctttaatgtgtattttataccgatcattaatatatgtccatgcagggtgttaggagtaaaaacaaattgatactacggctgatggagcatttggtttaccccaatccggctgcgtatagggagaaactgatacgattttctcaacttaaccacacaagttattctgaggtcatcatcgtcatatatatacactgttacaattttgatcatctcaatcacttttctgttagtactgagtttatgttaattgattattattaatagttagcactgaaggcaagtcaacttttagaacaaactaaactaagtgaacttcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagattatatcaggtttttacctttcatttctgcatcaacagagttgtcaatttgttgtcatagaaaattaaaggtgtttgatcagattgttttaaataaaatgtggtttaatatatgcatacatctttaaaaaaagaaacgacatgtatttattggtaaaaaactaaaacatcaaatcaagtgtggattttatactgttttttacaaaactttgtaaactgattatatgttgtttacttgaacagataaatgttttaaactattaagaatatttaaaagatggaataagaataaatttaaagtcatttctgagttgtggcccttgagaatagctgttcatgtagttagtagacctatttgacttttttctaaaatgtatactacactgtttattaatgcctactcaaatgaatcgggttgtctaaaataaaacatcacttataacaacaataaaagaagcaaagcagtcattttagtttgcacttttgcaattctcttggtaggaagaaatctaatatgattttaactgaccatgcttctcatatctgtatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacaggtatgtgatgataatgttacatgaaaagataccatcaaacctgctttatgatctttgtgtcatgctcaagaaacaaaataactggataaatataaaaactgagacccatcatcattcgatgatgcatgccatgttaacagtcggtagatttgatggcttattcattagctggtgacatatatttgccctgttgatgttatgttcacttgttatgtgatgaactgtagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcactggtcagaagagaatcattattatattgaagagccattattgcgtcacttggagcctccattatcgacatatcttgaactggtttgtgctcaaaagacccttcataatttttcaattcattaataatattataataccaatgaagttgtaaatgtattgcttatgcaggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaattggtgatcttgttccatacacaacgtaagtattcatgtcatcttcatgaatttttttttatcatatgcactcatttaacaatggtaatatgttgtgaacaggagagtggatgtagattctgggacagaagattgcgtggttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtaagtcattagataggattatagacatttcagcaatacccctcaaacatgcttttacctaaagtcaattgctgcaattttgatttaggtatatcgtgaactggaagatactggtttgcacaaggtgtatcatgctacctctacattgggtcctttgcatggcgtacctgtgaatacaccctttcagcctttaggattacttgatcagaagcgtcttttggcaaggaaaagcaatactacgtactgctacgactttgcactggtataactatcattttgctctttcaatgcttgatggtcacctaaatttgattgtacagaaacacttattaccatatctatatttccaggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtggtggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtgaacaaactctcttttattttcccttagaactatttaatttaattatctatgaatgcgcaaaaacaacagttttatttaaatatttttctttcactatgctgcaggtggatccagtgaccaaaaataaactagtcgaagaactcttgcgcgtaattaagtaggtaattatacacaaagctcatcagattctttctttgtttgtcaaagtgagaagccttttgagcagtgtacattataagtaggtgtcataagaaaacaggctcaaaatagtttaaagtatatgaggtttaccatgttcagattgttttatttttcttcataaattgtataataccatcacatttctatcgcattttttatatatctatatataaatggtcattttttattttattttatttttataaaaggttctctttgaccatctttgtgtttccttttggctcttcttgtccatcttcagttcttctccttccttcgctttcttttcgtctcttgagttatcttttctttatcttctcatcgtgtacggattacgttgatatgagcacatatggcaaagttgattcagataactccacaacaaattttcacttgatttttgaatgtttataagcttacaatacatccatgcactcatgttcatctgctaaatgtactagtacataatcaagttaaaaacttcaacccaagaacactattccactaaaaatttcggcatgatctcatcataaaatctacaatcattgtttattgtcaaccatcaaagacctgtagaatactaatgaacaattgcaacaagtgaacagtttgccccttgttactgttgaatgaatatttcaaagatcatgatcgagcctcgatcttgaccagcactgaaacattataaaaacaacttccattttaaatgtttgtctaatatagggaagtgagagtcaggtagcccacaatgttttagaccccagagctacttgttctggctgtggggttaaatatagttatatagacttatgttaagtgcaggcattacacacttttttgcattatatgtttacgcgcagatatatgtatttgtgaccagttaaaccggtgtgcttctcttttctgtgtaatgagctctgttatgcagtttcgggtttgagtcgctttgtgataattttgtatgtgttactggcccggccagataaatgatcggttgatataggctggttctagtcacactagacgctgattagtggttaggcttcgatgtataaatcaaagttatagctacattcaaatcattattataattatttctatttcattcaaagtaggaagattatatcatacataaatatgacacagaggatgaatttcataaacttcaattctacttttcattaaaagcttaatttatctagttgcccggtttcccattcttcttcccgttgccgccaccaggccttttactccaccatggccaccccctccttccccaaccaccaaatggatatccaccccagatacctggccatccaccacctggccaaaatccgccaccaggaaaatatccaccacctggccaataacccccataatacggatatgatgggtcatagccccctccatatcctttacctcttcctggtccaccgtaccctccatatccatcacccgaatcataacctccccctccaccatatctgccaccatgatcttttccacgtccttcatcataaccaccatcttctccaccatgatcttttccacgtccttcatcgtcgtcccctttgccttcatgatcaccatcttcaccaccatgatcttctccaggttcatcatcatcatggtcatcgccttttcccccttcatcaccatgatctcttcctggtccatcttgtccaccaccttcatgatcaccaccttcatcaccatgatcttgtccaggtccatcatcatcatggtcaccaccttttcccccttcgccaccatgatctcttcctggtccatcttgtccgccaccttcatgatcaccgccttcacca

SEQ ID NO: 51 - DNA, 16098 bp, Conyza canadensis
agtagagtctagattaaaatttcatatacgattgatattataaagtgaataatagtagccttgacgagtcaaagagatatcacagagagatattagaatccggacattactaacggcataggattaacggaatttgtggttttaaaacagtaattatctaagaaatatgaaacaagaagttatatattcgaataaacttggatacaataatttgattacatgttagttcaaccataatcaaatactcgaaagtcgtaatacactaccaatatcttgattcatatcatttgcattgactaaatcactaaaatcatcattaaattacaacaaaaatattatgtattggactattgggggtggggtggggtagggtagggtagggggtttggttacccatctcacgtggcatgcatcacctctcatattatatgcaggcatactaaacaaaccaaatacccaacaaaaaacacccatatttcagcaattccaactttcttgcaacaacgttattattatttttatcttgtaaattcttgattgattcaactgcttttccacttgttcatggttagtctttctcattctttatattttgaaaaaaagatgatttttagtgattaaagattgaatcttttttctaagtttatgtcatttcttgaaatttttgtgcttctagaattgggtttactgtgttatatgaatttaataagtaaaaaagatgattttagtgattaaagactgaatcttttttctaagtttatgtcatttcttgaaattcttgtgcttcttgaactgggtttactgtgttatatgaatttaacaagtaaaaaagatgattttagtgattaaagattgaattattttactgggtgtaatgtcatttcttaaaattcttgtgtttcttgaattattatgaatttaagtagtaagtatacaaaagatgatttactggggtaaaggttgaatcattttactgggtgttatgtcattttgtgaaatacttgtgatttttgaattgggtttactgggttttatgaattcaagtagtagtgcaaaaaaatgatgaagagggtgttggaaagattaactcattactgaatttaggaaagccaaataatgagagattagtgtttggcagaacaaatgaattttctgggtcttgaacatagtttgaaaaagcatgctgggacatgtttttccaaaaatgctattttgtaaacaaaatttcaaactcctcctttgcagttaaagattgaatctttcttaccgggtatatgtcgtttcttgaaattcgtgtctttcttgaattgggtttactgtttaacgattaaactttgagactttttactatgtttatgttaatttctttctctcaatgttgtgatttgactttggaatgctgtctaattaactatagttttgttgattttgacattttttttggcatatgggtatgcatcttaggaggatcttttatgtgttttgttgggttacatttgtttgataagattttggattaatcaagtggacatgatgaaactttatgtgatgaaataatataaaaatcccaatatagaattaaacacagaattaaaaagtagatatgatgcgcacattccgcctttttgatcccacaagtaacttttagattggatcactgactataaaatattccacatcattctataaaaaatcagaattctggattataaaatacacattggtatccattttttgaagcaccaaagtttgatccctttgtgatacttcatattcagtttcacgtggttattaatttattatctgaaattgtaattttcatttgaattcgcctgtttgatttacaaaatttgagttgcaagttctgtttttatcccccttaagtttgcttcaagaaaatagttaagattattaaagaagaaaaaacccagttgtttgaccatttaggaatttaagtaatgctgaactaaactttgattggtctacttggcagtggaaccatgccagaagctcaaagaatgcctctaaatggaagccttaatcttggtaatggttatgtaaatggggccatttcattgaggtcttctgctagcagatctgccattgatgaattttgtaatgcacttggggggaataggccaatccatagtattttaattgcaaacaatggaatggctgctgtaaagtttataagaagtgtgaggacatggagttatgaaacgtttggttcagaaaaagcaattttgttggtagccatggctacacctgaggatatgaggattaatgccgagcatattagaattgctgatcagtttgttgaagtcccaggtggtacaaataataataattatgctaatgtgcagctcatcgtggaggtaagtatggatccgacactcgtttatttacataccactaagtgactgactttatgagccgggtcatatttggctttttatcgcacatcagctgtagctgttttgtatatgccgaaagaccagtatattgggtgatcactatcaattttctttagaagtttgagtttgtgtctgattatttcagactgctgagataacacatgttgatgctgtttggcctggttggggtcatgcctctgaaattcctgaattacctgatgcattggacgcaaagggaattgtatttcttgggccgccggcttcatccatggcggctttaggagacaaaatcggctcttctttaattgcacaagctgctgacgtgccaacacttccttggagtggttctcatgtaaaattttccaccattgttttattacttttaccattacagtgagcttgacacctcttatttttcaaaattggagattaatgcccctcagctataagaatttggatatttataccttctgatttccaaccaacatatctatgtgtttttgaaaatcatacgtgtatctatacctcttactcttaaataatctaatcctttttttttctttgttcaaaatcacacaaatatgttgctcatttgtcaaatttatatctttcaggtgaaaatttctgcagagagctgcttagacacaattccagatgacgtatatagaaaagcttgtgtccatacaaccgaggaagcagttgcttcttgtcaagttattggttatcctgctatgatcaaggcatcatggggcggtggtggcaaaggcataagaaaggtgtgcttccttacatttgagaataatttttatgtgaagttgtcaaaggtgtagaatgaagtgataacacattaatctgtaggtgcatagtgatgaagaagtcaagacactttttaagcaagttcagggtgaagtccctggttcccccatatttattatgaaagttgcttcccaggtgagaaaacattctaatatctttctaaccgtaatatgcatttatcattttttctttctaaaagcattttttgtcatttatcatttgttgtcggaaaatagagccgacatctagaagtacaactcctctgtgatcagcatggcaatgtagcggctttacatagtcgggattgcagtgttcaaaggcggcatcaaaaggttcacccaattcaattgtttaattcattttttcctttttatcttgtttttaatcttttttttttggataatttcaagattatcgaggaggggccaataaccatagccccccctgacacaataaaaaaattggagcaagcggcaagaagattagccaaatcggtcaattatgttggagctgcaactgtagagtatttgtacagtatggaaaccggagattattactttttggagctcaatccccgtttacaggtgcaagtgttttttttggtgctgtatattggaggacactagatgtgattcattctcagtcatatctgacacctttttattaggttgagcatcctgtcactgagtggatagcggaagttaatctacctgcagcacaagttgcggttggaatgggcattccactttggcaaattcccggtaatatgtcagaataagccataaatgtaatgaacggttgacaattgttggccatcatacttgtctacctagcacttgtcattgaaatttataaaaaagacctgtctatttaggagtatcttttgaacctttttttctttgctttagaaataagacggttttatggaaaggaaaacggtggagggtatgatgcttggaggagaacatcggttcttgcaaccccatttgattttgatcgcgccgagtcagttaggccgaagggtcattgtgttgctgtacgtgtaacaagtgaagatccggatgatggttttaagcccaccagtggaaaagttcaggtttttgaaaagacttatgcacccttacgaaaataccaaatattataagtattgattatatagcatactgattgacaactttttaggagctaagttttaaaagcaagccaaacgtatgggcatacttttctgtcaaggtactcttgtctcccatttatagacatttatgtaactgcttgattgccaaactacatttttttacttgctaacaccttggactcttgcagtctggaggaggcattcatgaattctcagattctcaattcggtaaaggccgaatcttgtttgggttctgtttaaatgtttgaatctccaattgttagcgtagttaaattttatgagaatcactgccaagatgtttttttctcattttagttttttacatacctcaggtcatgtttttgcatttggagagtcaagaacattggctattgcaaatatggttcttgggctaaaggaaattcaaattcgtggcgaaatgcgcactaatgttgattatacaattgatttattacatgtgagcaacttggccttcaaagttaaattcgttttgataatattcatttacttcaaataaattacattttttctttgtaatcttcaaaatatataaatttataaagtacacacatcacattgggcgaagaaaagtacactccataaagtttagaatttttttaaaaaaattttcattcttttttcttattcttacacttattagtgtgaactttcacattcttgatttttctttcttatttctgcacatgtaggctccagattatagagaaaacaaaatacacacgggttggttagatagccgaattgcgatgcgggttagagcagaaaggcctccttggtatctttcggtagtggggggagctctttacgtaagtcatttcatatcacaatgtggtttctctattacttatcatcttttgaagcacttccacttaccatcggcttttgtcgacctcagaaagccgctgctagaagtgcagccatggcctctgactatgttggttatcttgaaaaggggcaaatccctccaaaggtatcatgcattccgaaatttagaacttgggttttgtttttataaaaattggttaaaagtcgttatgtttgttttacttattaatgtttcattacttgcagcatttatcactagtcaactctcaagttactttgaatattgaggggagcagatacacagtgagtaacaagatacacaagctactaggattttttttgtgtgtatattaattcatcttttctgattctcgtatttgttgttagattgatatggtaaaaagaggacctggaggttatagattgaaaatgaaccaatctgagattgaagcagaaatacatactctacgtgacgggggtttattgatgcaggtatgtaattcataatgattcattttcgttttctgggtttatttagaactgtacaatgtgtatcatataaaatgcatcttaacattggggtgcatctgtgaatcaaaatgataatcactataatgttacataaattgttactatttaagaaaaatgggtataactgaatataccagaaattatgttttaccgattgataatcagttttcttgcagttagttacaaactgatagtcgtagctgaaatgggtcacccaaacacttgaaagtgattactgcgacttgaagttgcattaattggataatcactttcaaagcgaattgttatatacaccaataacacaatgatatctaactggttgatttaatgtggtagttggatgggaatagtcatattatatatgctgaagaagaagccgctggtactcgtctcctcattgatggacggacatgtttgcttcaggtgccaacaactttttttgttaacttttgctgtagtggtggcaacatttactcatctatttttaaattagtcagtttgagtcatatttaagatctaaagtgtcaaacgggttaaatagaaaaaactgaaggaaactggtcaaataggcggtaagtggcctgtgtgtattcaacacacataaccttccaaattattttttgttggaaatatatcattcttatatcatattcggaggactagtttacataaataattttactttttatacaaaaagtgtttgtgttcaatccaaaatcaacccaacctgtactgtacaaaattacctgttttgacctgaaccagatctgttacccagcctgatgggatatctcaatttgtcacctttaccatatccttgcttgtgtggattttaagtttgcattacttctttttagaatgatcatgatccttccaagctggtggccgaaacaccatgcaaacttctaagatacttagtctcagatagtagccatgtcgatgctgacacaccttatgctgaggtggaggtaatgaagatgtgtatgccgctactttcgccggcttctggagttatacagtttaagatgtctgaaggtcaagcaatgcatgttagccctttttctctattttttattccattttcgtcttcttcaaatcatacaccgtggacccacgaaacaaagaaagtttatttatttgagctgttatgaatgacttcatttgtaggctggtgagctaatagcaaggcttgatcttgatgacccatcagcagtaagaaaagcagagcctttccatggaacttttcctcttcttgggtcttcaactgccatgtcagataaagttcatcaaaagtgtgctacaactctaagtgccgctcgaatgattcttgcaggctatgatcacgatattgatgaagtaatcttttcgccgtataaggattttacagtttcaaaaagaagttgttcttctgttaacaagtttaaccttttattgtaggttgtcaaaaaccttcttcgttgtctagataatcccaagctacctttcctccagtggcaagaatgctttgcagttctagccaatcgacttcctaaagatttaaaaaacaaggcaaatttacatcttataattcttatctatttttcttttctttcaaattggaacattgaaatgtatttttctaattctgttatttgtatattcagttggaaacaaaatttaaggagtacgaaggaatttccacccaacaagctattgatttccccgccaaattattatggggaattcttgaagttagtttgcgattaataattttttttattatacacatacactttttcatatttaaagatgtaatatggtaatgctatctgcacagacacatcttgaattgtgctcggaaaaggaaaggggagcccaagaaaggcttgctgagccattaatgagtcttgtcaagtcctatgaaggtggcagagagagtcatgcacgtgggatcgttcatgctctttttgaagcatatttatctgttgaagagctatttagcgacaacattcaggtgcgtttttttctgctgtgttgatccatgttttttttttgggatttctgatcgggcatgtactaccataacagttctttctattttatctttttacactacacagcccaatttttttcaaggttaacacattcccaccttagctttaaaaacctatttacctatgaccgggtcggcaaaagttatccctttatttcaaactttgaaactggtaaaaagtcaaccaaagtgtagttattaattcattaaaccctttgaattacttttccaaaacttggattattataaaataaagtttctgggcaatagtgtttccggtcaaccaacctgttcaaaaaatgacatgatttgacttgtttctggacatgatataatgtttcaggctgatgtaattgaacgtcttagacaacaatacaagaaggatctgtcgagggttgttgacatcgtgatttcacatcaggtatgttaattccactgttttgtatcttccattctaattgtttaagttaacaacctattttatgtcgacacagggtgttaagactaaaaacaaactgatactacgactgatggagcatttggtttaccctaatccagccgcctatagggaaaatctgatacggttttctcaattgaaccacactagttattctgaggtcaatattgtcatttgacatactcataccagtttgaatatttttccgaatcttttttatgctaatactagtttgtgtttctcatttcttgttaatagttagcattgaaggcaagtcagctgctagaacagactaaactgagtgaacttcgttcaagcatagctagaagtctttctgagttagagatgtttaccgaagaaggtgagaatatagatacccctaagaggaagagtgccattgatgaaagaatggaggatattgtgagtgctcctttggcggtcgaagatgcccttgttggtctttttgatcacagtgatcacacccttcaaaggcgtgttgttgagacctatgttcgaaggctatatcaggtatttttgcttctctcatataaaataattaatttgtatcacataactggagtctgcattataactgaagcaaatttcttggaatgttataaagatgaaatcatagttatagtttcaattaaaggcattattggtaacacttacattgtatgcatcattttggtagtgtgagcagagtagtgattttcatggcaattaaaaattaaaatgctttgtttcatctcttactgaattacactgttgttcacaaaactacttaaattgattttcatctgaactttttgtgccaaataccttggtttttctatccagatttacttttgtcttttttacccaacaaggccagagcaatgatcttgatttaggtacacaagattcttgtgttaaaggagtcctacatttgattaatgatcaacatatttttcaaataccacaatttatattgtaatacagggtgtgtattttgacttcagacctttttcagctatttttgtagtaggcagaaagttgttaactgaattaatataaaaatatatataaaaagtgaagaaatgtgtttgagtattgtaatgtatactctatgtttagctggctggaaatgttccactatcttgtatatgtctactacactcttcatgaattgctaaagaaaagaattttgtgatgtaaatatatattcagttatttacacttcttacgggccaaagtcacgtgaggtttactgaccactcacttcatatctgttatcagccatatctcgtgaagaggagtgttaagatgcagtggcacagatccggacttattgcttcatggcaattcatggaaggacacgctgaagctgttaatgtgtctgattatgaaactattgatacacaattggtagataagaaatggggagctatggttattattagatctcttcaatttttacctgatgtcataagtgcagctcttaaagaaactacttataaacatcatggcacaagtcaaaatggggatgccaatccaagttatcaaggttatatgatgcatattgcattggtaggcatcaacaaccaaatgagtttgcttcaagacaggtatacaatgtttcatgttgatcttatgtatcgaatttgtaaaataccatttgctacaaaaagttgaaataaagcaacttattgtacccaagttgtttatgtgtactgatgctagagtgtcaaaacagacaggttggatagcatgcctaaactgatttgggtcaaaacgggccagattaaatctgctcccatttgtattaaaatctttctattttacaagtacttaatgtaatattggatgcttacaacgactatattatatcctttattaacttttagcttagtacaaacatacatataatattccctgtattaactcttagctaagtacttaatgtattttggatgcttacaacaactatcatattacctgtttgacctgttatcaactaagtacaaacatacatataaatggctgtgataactaggtgaccaaccttaaattaccaaaaaggtacttgttgtatttttcatcaaactaaccatctcatgacattatgtcattatgatatgccatggtatagggataaaaatggaaaaatgggcctagtatcaggccatgatatttgccatgtttaccaaaggataagtttgatggatataatttttttttccccgatgatctgaaattaatggacatgttatctttttaactgcagtggtgatgaggatcaggctcaagagagagtcaacaagttagcaaaaatactcaaagataaagaaataagtgtgaaactaaaaaatgcaggatatgaagttgtaagttgcataatacaaagagacgaaggtagaggcccggtgagacactcatttcactggtcagaaaagaatcgttattatatcgaagagccatcattgcgtcatttggagcctccattatcgatttatcttgaactggtttgtactcttaacacgcctgaatacgttcttgataacgaaagaacaataattcataaatgtattatttgtttaggacaagcttaagggctatgagaatgtaaagtacactccatcacgtgaccgtcaatggcacatgtatactgttgatgctaaaccacttccggttcaaagaatgtttcttagaacgcttgtaaggcacccgacaaaagaatggttcttgccctcaggataccaagattcggaagttgtggacccacggtctcagttaactttaccttttacatcaaggagcatcttgagatctttagtgaccgccatggaggagttggaacttcatgttcataatgctatagtcaagtcggaccatgctcatatgtacctctatatattgaaagaacaacaaataaatgatcttgttccatatactaagtaagcattgccatcctctttctgagacattatatatgtatggataatattataatttcacaagttgtaaacaggagagtggatgtagattctggtaaagaagaaggtgtggttgagacgcttttggtgaagttggtccgtgaacttcattcgatggttggggtaaagatgcaccggttaggtgtttttgagtgggaggtgaagctttgtatggtatcatctggtgaagccaacggtgtttggagggtggtggtcacaaatgtgactgggcatacctgcaatgtacatgtaagtcattaaacggactttttagacatttgaccatactcgatatcttttacctacaatgaatttttgaaatttgtatataggtgtatcgggaagtagaagatactgttaaacacaaggcagtgtatcatgctccctctacattgggacctttacatggtgtgctggtgaacacaccctttcagcctctgggattactcgatcagaagcgtcttgtcgccaggaaaagcaatactacttactgctacgactttgcactggtaaaatccccgttcttcccttttaagtcagatatgcatttgctatactattttttacaaagtactggttcttattgatcatacttgtatgtgcaggcatttgaagcagcccttgagaatatctggtcatcaaaactgcctggtgtaagcaggcccaagggcaaacttgtaaatgcgatggagcttgtgtttgctgaccgaagaggtttatggggcactccacttgtgccagtaacgcgcgagcctggacaaaataatgtgggaatggtagcgtggactatggacctctgcacaccagaatttcctgatggtaggacgattttagttgtttcaaatgacgtcacatttaaaaacggatcttttggtcctatcgaggatgcgttttttgaggcagtcactgagcttgcttgtgccaaaaaactgccgctcatttacctggcggcaaactcaggggcccgtatcggggtggccgaagaggtcagatccagctttagaattgggtggtctgatgagtcaactcccgactccggctttcagtatttgtatctaactcccgaagattactctcgtttggaatcatcagtaatagcacatgaaattcgtctatccagtggtgaaacaagatgggtcattgatactattgtcgggaaagaggatggattaggggttgagaatttgagtggtagtggggcgattgctggggctttttcgaaggcatataaagaaacttttactttaacctacgtgactggaagaactgttgggataggtgcatatctggcccgtcttgggatgcgatgcatacaaaggcttgatcaaccgattattttaactgggttttctgcactaaacaagcttttgggccgagaggtttatagttcgcagatgcaacttggtggacctaaaattatggccacgaatggcgttgttcatcaaactgtatctgatgatttggaaggtgtctcggctatcttgaactggttgagctatgttccgccttacgttggcggtccacttcctgttttgccacccatggatccaccagacaggcccgtcgagtacctgcctgaaaactcatgtgatcctagggcagccatttgtgggaccgtggatggtaacgggaaatgggttggtgggattttcgacagaaacagttttgtggagacgttggaaggttgggcaaggacagttgtaacaggtcgggcgaaactcggtggaatccctgtgggggttgttgctgtcgagacacaaacgatgatgcaagttatacctgcggatcctgggcagctcgattcacatgaacgtgtagttcctcaagctgggcaggtctggttcccggattctgctagtaagacagctcaagcgctgatggattttaatcgagaagagctcccccttttcattatggcaaactggcgagggttttcagccggtcaacgtgacctttttgaagggattctacaagcgggatcgacaattgtagagaatcttagaacctataaacagccagtttttgtctacattccaaaaacaggtgagcttcgaggtggtgcatgggtggtcgttgacagtcgaatcaattcagaccatatagaaatgtatgcagaaacaactgcgaaaggaaatgttcttgaacccgaaggtatgattgaaataaagttccgaaataaagagctggtagactgcatgggtcgattggacccactaatttgcaatctaaaagaaaaacttaaagaaacgaagctcgatcaagcaatcacccagcagataaaagcccgtgagaaacagcttttaccaatttacactcaaatcgctacaaagtttgctgaacttcatgacacatcattccgaatggctgaaaaaggtgttgtcaaaaaggttgttgactgggcaatttcccggtttttcttctacaaaagactccagcgtaggctggccgaggcttctctaatcaagagtgctcgtgatgctgctggtgacacgctttcacacaaatctgctcatgaaatgatcaaaaaatggtttttggacacaaaaagtgaagatatgtgggtgaatgacgacgcctttttcacatggaaagatgatccattgaactatactagcaaattagccgatctacgtacacagaagatatcaaatcagttattaaagattggcagttcaccttccgatctgcaagctttaccacagggactcgctgcacttttgcaagaggtaaaccataatatcccgattacctgccgttttaaaattcataaatttcactgttttgtttaactttgttgtgttcttctatgatgtaggtgaatcctgcagccaaaaataaattgattgaagaactcaggcggataattgagtaggaatcgataggtaactattatcaaggagttcttcattataaattttgccagcagtttgagatttttccagccaaatgagaagcctttgaacctgtgtacattaaggtgttgatagggagatagagtaaagatagtataaattgtaattagtgttcacaagaactttacattagaatcattatatatcatggtcaattcttttaacaaacataattcaaattcatattctgatattcatatgttgaaacaattgcttttctttttgatttttttgttctcttttcccttcggtttctgtttctttactttactttctcgtttgcgttcttctttttcctttctctcaagttcttctctttcctttgcttttttcttctttctttcgagttcttcttttttccttaacttatctttctcgtgttttaccttctctttctcgtgttttaccttctctttcattttctttttcattttcttcttctcttttcgtaggagtatccgcttgatgatgttcatacacattcttactttggaattattgtctgcaaatgtcaaatcaatagagaactatgtagatatgctttaaatggcatatacttctttttgtttttgtcaattatttatttataggtgcatacatagtgtttatcaacattgtaggaaatgacaaaagtttgtttttcaaacgggcaaaccagattctcgttgtaatcaactgtaacaatgtaggattgtgtttgtccgtcgaccaaatgttgcaagttcgatcaatatctgtacgaacgtttcaatcaacacatcgaagaataattgaatataatccaagttaatgtttgaaaagcaacaagataacaatataagattggtggtcctgttcagaaaatggtatttatgtttaactgtgtatgaagtaaaacaaacatatgattgagattttaattctcaacatcaatttcaacactaacataagttcattactaagatatagttttccattattagcttagacttctgtcataaaaaacggacatcaagtaaatgtagaaaaatgtagcgtcatatgtctttacacggattcaaaccattatacaacttacaaactgttgacggttatatcatgtgcaattgtctaacagaatccaaaagcgtaaaaaaaagaggcaaaattgcagtttcctacattgttctctttatctccaagccctagtcatttcatgtataaacaatctaacaaacaagcttattctgtaaaaaatccaacaattctgatttcatatataggttgagtacatatggggattctaactagtgagtagtgactctaaactttaattcttcttgcacttcacattttactgatgaggtcagacctcatgagcagactttgatgaacatgtatgaacagcatctgcaactgtgagaaaaatcttgttttcgccaatcaagtcagggaaatccgctgcatatagcttgtctaggacgagttgcccggggtttgcaagaacaagctgccatgtcaatttagtttttagtccttgagatggcattacaacacatgcaatttattatttatacacacttagaaccatttgttaataaattggagactgttttactaacctgaacatctctcttttgcaaacttctgtgtaactcttcaaaggcatggattccactggtgtcaatatcagtaacagctgcaattaggcaaccatacgttagagagaaaagtttcaatgacccaaaatgtaaaggtaaccatggtaaaagctagtttcttacgcgacatttcaactattaagaattgaatatttggtaggtatgctgcttttagattttcttcttcctcagttagccatctcaatatcctgcaaataaagtgctcgatttattacttgaaaatgatctgctggataatctatatagttcaagattcttaaaataattcacagtttgcagaaaaaaatgtacctttctttgatgtagttggagttggaaa

SEQ ID NO: 52 - DNA, 2292 bp, Euphorbia heterophylla
ccggaaggaaaatcttgatagtagcgaacgacgtgaccttcaaagccgggtctttcggcccgagagaggatgcattcttttccgccataaccgatcttgcatgcaccaaaaagctccctttagtctacctggcagcaaactctggtgctcgtataggtgttgccgaggaagtcaagtcttgctttaaagtcggttggtcagatgagtcatctcccgagcgtggtttccagtacgtatatttgactcccgaggattatgtaaccattggatcatcggtgatagcacacgagctgaatcagaatggagaaacacggtgggtcatagatgccattgttgggaaagaggatggcttaggtgtcgaaaatttatcgggaagtggagccattgctagtgcatactcaagggcatataaggaaaccttcacattgacatacgtaactggaagaacagtgggaatcggtgcttacctggcacgcctcgggatgagatgcatacaacggctcgatcaaccgatcatcttgaccgggttctccgcgttaaacaaactcctcggccgtgaagtgtatagctctcacatgcaactcggcggtccgaaaattatggccaccaatggggtagtccatcgcaccgtctccgatgacctcgaaggtatttcggaaatcctgaaatggctaagctgtattccccctcaaagcggcggggcaattccggtatttccttctccggatcctccggagcgacccgtggagtacttcccagaaacatcgtgcgacccgcgggcggccatctcgggtacaatggacggcagcgggaagaagtggctcgggggtattttcgacaaagacagcttcgtggagacactggaagggtgggcgaggaccgtggtgaccgggcgggcaaagctcggggggattccggttgggataatagccgtcgagactcaaaccgtgatgcaagtgatccccgccgacccgggccagctggactcgcacgagcgggtcgtgccccaggcgggtcaagtatggttcccagattcggcgaataaaaccgcccaagcgattatggatttcaaccgagaagagctcccgctctttatcctcgccaactggcgaggcttctcgggcggccaacgagacctcttcgaaggtatccttcaggcggggtccaccatagtggaaaacttaaggacatataaccaaccggttttcgtatacatccctatgatgggcgagcttcgtggtggggcctgggttgttgtggacagtcagataaattctgaccacatcgagatgtacgctgatcggacggctaaaggcaacgtccttgaaccggaaggaataatcgagatcaagtttagaacaaaggagttgctcgattgcatgaatcgactcgacccaaagctgatatcttttaaaaccaaactaaccgaagcgaagaatagtgggacctacgggatggtcgattccgtacaacagcagataaaatcccgggaaaagcaacttctgccgctatacacacaaatcgccacacgattcgccgagcttcacgactcggctttacgaatggcggcaaagggggtgattcgagaagttgtcgactgggggatttcacgatcttacttctacaaaaggttaagaaggagaatcgccgaggcttcgttggtgaacaccgtgaaagatgcagcgggtgataagctccagcataagtcggctatggagttggtcaaaaactggtttctggactcgaaaggcgattgggaaaacgatgaagctttctatgcttggaaggataatcccgcgaattacgaggaaaagctacaggagttacgggtccagaaggtgttgcttcagttaactaacattggcgagtctttgtcggatttgaaagctttacctcaaggtcttgctgcccttctaaataaggtggagccatcgagccgaggggcgttgatcgatgagcttcggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtgaatagggggaattagttcatatgattattgttgttataaacaaatcagagatagagagagctatatttattattatatttgcgaattaaagttattaggagtagtataatttggcggttgttgcattttacgtgtaatgatctgaatgttgtttgttcgtgattattg

SEQ ID NO: 53 - DNA, 1338 bp, Euphorbia heterophylla
ttgacgggaggacttgcttgctacagaatgatcatgatccgtcaaagttagtggcagagacgccatgcaaacttctgagatatttggtttcagatggtagtcatattgaagctgatgctccatatgcagaggttgaagttatgaagatgtgcatgcctcttctttcacctgcttctggagttgtccattttaaaatgtctgaaggtcaagcaatgcaggctggggagctcattgcaaggcttgatcttgatgatccttctgctgtaagaaggcagaaccttttcatgggagattcccgctacttggctctcctactgctatttctggtaaagttcatcagagatgtgctgcaagtctaaatgcagcccgtatgattctcgctggctacgatcataatattgatgaagtagtgcaaaacttgctcaattgccttgatagtcctgaactccctttccttcagtggcaagagtgcttgtctgttctagcaactcgccttcccaaggatcttaggagcgagttggaatcaaaatacacagagtttgaaggaatttcgagctcccagaacattgacttccctgccaaactgttaaggggtgtcctcgaggcacacctgaaatcctgtcctgagaaagaaaaaggagcgttggaaaggcttgttgaacctttgatgagtcttgtaaagtcttatgagggaggacgtgagagtcatgctcgagtgatcgtccaatcactttttgaagagtatttatctgtagaagaattatttagtgacaacatccaggctgatgtgattgaacgtctcagacttcaatataagaaagaccttttgaagatagtggacattgtcctttctcatcagggtgttaagagtaaaaataagctgatactacggctcatggaacaacttgtttaccccaaccctgctgcatatagggataaactcattcggttctctcagcttaaccacaccagctattccgagttggcattgaaggcaagtcaactcctagaacaaaccaaactgagtgaactccgttccactattgctagaagcctttcggaattggagatgtttaccgaggatggtgaaaatatggatactcccaaaaggaaaagtgccattaatgaacgtatggaggatcttgtgagtgctcctttggctgttgaagatgctttagtgggtcttttcgagcacagtgatcacacccttcaaaggcgagtggtggaaacttatgttcgtaggctatatcagccctatctggtcaaaggtagtgtcaggatgcagtggcatagatttggtcttattgctacatgggaattcttgggagagcatatcgg

SEQ ID NO: 54 - DNA, 1250 bp, Euphorbia heterophylla
taatatgatgcacatagcattggtaggcatcaataatcagatgagcttactacaggatagtggtgatgaggatcaggcacaagagagaattaacaagttagccaagattctcaaagaacaggaactaggttccagtttgagcttgtcaggcgttggagttattagctgtatcatacagagggatgaagggagagcccctatgaggcactcctttcactggtcagaggaaaagctttatatgaggaagaacctctattgcgacatttggaacctccactatccatctaccttgaactggacaaacttaaaggctatgacaatagacaatatactcagtcaagggacagacaatggcacatgtacactgttgtagacaaaccagttccaatccagaggatgtttctaagaacccttgtgagacagcccacaagtacttcatatcaaggtcttggcgccgaagcacccaatgtgcagtgggccatgtcctttacgtcaaagagcattttgaggtccttagtagctgcaatggaggaactggagcttcacgtgcacactgtcaaatctgaccatgctcatatgtacctctgcatattgagggagcaacggatagaagatcttgttccatacacgaagaaaaccgatgtagatgccaaccaagaagaagctgcggtagcaagaatcttggaagaactagcgaggaagatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatatatatcgggaacttggggacgacagcaaacacgaagtggtttaccattcgatctctccaagaggcccactgcatagcatgccagtgaatgctgtttatcagcccttgggagttctcgatcgaaaacgtttgttggcaaggaagagcaacaccacttactgctatgattttccactggcgtttgagacagccatcgaacaattatgggaatctcaatcaccagggactgaaagaagcaaagaaaacgtcctaaaagtctcggagcttgtttttgccgatcagaaaggtacctggggaactccacttgttcatgcagaacggccagctgggcttaatgacgtgggcatggtagcatggtgcatggaaatgttcaccccggaatgcccttccggaaggaaatcttg

SEQ ID NO: 55 - DNA, 959 bp, Euphorbia heterophylla
tcgctcataatcgcttgatcgcagtcctattcgagttcaatttttttgagattccgcttatattttcagaatgttggagacacagaggaggcagccgttagcagtaggggttactcgtgggaatgatttcaccaatggtgtgcttacgatgagaagccctgctacaatatcagaagtagatcaattttgccgtgctcttggaggaaagagaccgatccacagtatattaattgcaaacaatggaatggcagctgtcaagtttatacgaagtgttaggacatgggcttatgaaacttttggcactgaaaaggctatcttgttggtggccatggcaactccagaagacatgaggatcaatgcagagcatattagaatagctgatcagtttgtggaagttcctggggggacaaacaataacaattatgccaatgtgcaactcattgttgagatggcagaggtcacccatgttgatgcagtttggcctggttggggacatgcatctgaaaacccagagcttccagatgcactaactgcaaagggaatcgtatttcttgggcccccagctgcgtccatgggagctttgggtgataaaattggatcctctttgattgcgcaagcagcagatgttcctactcttccatggagtggctctcatgtgaaaattcctccagaaagttgtttgattaccatccccgatgacatatatagagaagcatgtgttcacacaacagaggaagctattgcaagctgccaagttgttggttaccctgctatgataaaggcatcatggggcggtggtggtaaaggcataagaaaggttcataatgatgatgaagttagggcattgtttaaacaagttcagggtgaagttccaggatcacccatatttataatgaaggttgcttcccagagtcgacatttagaagtccaattgctctgcgatcaatatggaaatgtag

SEQ ID NO: 56 - DNA, 935 bp, Euphorbia heterophylla
ccaattaccgttgcaccattggtgactgtaaaaaaactagagcaggcagctcgaaggttagcgaaatctgtgaattatgtgggcgctgctactgttgagtatttgtacagtatggaaactggcgagtactattttctagagctcaaccctcggttacaggtggagcatcctgtcacagagtggattgctgaaataaatttgcctgctgcccaagtagctgttgggatgggaattcctctgtggcaaattcctgagattaggcgattttatggaatggaacatggtggaggatatgatgcttggaggaaaacttcagtggctgctacgccttttgattttgacaaggtagactctacaaagccaaaaggtcattgtgtagctgtacgtgtgacaagtgaggatccagatgacggtttcaagcctactagtggaaaagtactggagctgagttttaaaagcaagccaaatgtgtgggcttatttctctgtgaagtctggtggaggcattcatgaattctcagattcacaatttggacatgtttttgcatttggggagtccagagctttggcaatagctaatatggttcttgggctgaaggaaatacagataagaggagaaatccgcaccaatgttgactactctgttgaccttttacatgcttcagattatagggaaaataaaattcacacaggttggttggacagtagaatagctatgagggttagagcagaaagacctccttggtacctctctgttgttggaggggcactatataaagcatctgctagcagcgcagctatggtttctgattatgttggttaccttgaaaagggccaaatccctcccaagcacatatcacttgtgaactctcaagtttcattgaacatcgaaggaagcaaatatacgattgacatggttagaggggggccagggag

SEQ ID NO: 57 - DNA, 12503 bp, Euphorbia heterophylla
ttttcaggtttgtttgtttcgattttccgattgtgttttttgagtcgctgttgcttgatttctgctgctgttactgctggttgactcttctagtgtgttgattgagatttgttagtttgattcgacttcgattttggaatcggatttttgaacttggagttgtaagtgttttgaagcgtgtttttcggcgttttagttgcgtttttcttatggatccgattcttttatatgaatgcggcgtttggcgctgagcaacatgaattggaataaacttgtggtattttgctctttttctatatattagtctaattcaacttcgattatggaatctgatttttgaatttggagtatatgtagtatatttaaacatgtttttcggtgttatcattgtgtattttttatggatcctgtgcatcggagatgcgtttatatgaatactgtgtttggtgctgagcaacataaattggattatacttgtcgaaaataattctcgtaataaggttcaaggtatctagaagtctacctgaagtgatatagtggaccatgcggatttgattctttgagttgtttttcttcaagtcaaagatcctgttatatttaattatttcttttgatttatgaaatgagtaattaagcaagtggtatgctcaattcgttgaaaatattatgtattgaaaaggatttgaaggttacgaactggattttcaactcgaatgagtttttttttgtgcagaatgttggagacacagaggaggcagccgttagcagtaggggttactcgtgggaatgatttcaccaatggtgtgcttacgatgagaagccctgctacaatatcagaagtagatcaattttgccgtgctcttggaggaaagagaccgatccacagtatattaattgcaaacaatggaatggcagctgtcaagtttatacgaagtgttaggacatgggcttatgaaacttttggcactgaaaaggctatcttgttggtggccatggcaactccagaagacatgaggatcaatgcagagcatattagaatagctgatcagtttgtggaagttcctggggggacaaacaataacaattatgccaatgtgcaactcattgttgaggtgtgtaagttcataaccttttagcatattggatagcttatgttgtgttagtctaaagttcgataattctaagcatataatgatattaaatgtgtttaaggatttctcagtaataggaatttgtaaatcttttctgtcaatgggttttacagaaattcataaattataatgtaatctagaagctttgaaattgtatttttgcacatctcagaagattatgaagtaataggctggtatacagtgaatttcattattgcaagatattgttgttatgtgctcactcaagagcattcttttcaatttggcaatgtgaaaaggttcagttagaaatatcacttgttacccttgttgtttgcataactaagtttgattttgtgtccagatggcagaggtcacccatgttgatgcagtttggcctggttggggacatgcatctgaaaacccagagcttccagatgcactaactgcaaagggaatcgtatttcttgggcccccagctgcgtccatgggagctttgggtgataaaattggatcctctttgattgcgcaagcagcagatgttcctactcttccatggagtggctctcatgtaagtaatgctcttctcaagctgttctttcattttctgtagtcattccaatctaagatatcatgatcttccttataggtgaaaattcctccagaaagttgtttgattaccatccccgatgacatatatagagaagcatgtgttcacacaacagaggaagctattgcaagctgccaagttgttggttaccctgctatgataaaggcatcatggggcggtggtggtaaaggcataagaaaggtttggcttcgatataacaaatttccgagtgtagtgttcaagtctgtagtgtacgatggctgagttttgttttcttggattatctaggttcataatgatgatgaagttagggcattgtttaaacaagttcagggtgaagttccaggatcacccatatttataatgaaggttgcttcccaggttaggatattatctagcttctaatttgatacaagagattttactttgtgattcttgacgcgtgaatcgaattctgatgatctatttgattttccttatgtagagtcgacatttagaagtccaattgctctgcgatcaatatggaaatgtagcagctttgcatagccgtgattgtagtgttcaaaggcggcatcaaaaggcatgtttatttctctcaagtaattttgattttgtctgcttagtgaaattgaccatgaaagtataagcttagtgtgaagagcctgaggctctgaccacatgcatgttgagaatgagccagtgacttttaatcagtggctcaaccattaatttctccccttccaaatttcaactgtttgtacatctatctagtatctactacatgggttatgcatttcaaaaaaggcctaacttgtgttgagatgtgaaacagataattgaggagggtccaattaccgttgcaccattggtgactgtaaaaaaactagagcaggcagctcgaaggttagcgaaatctgtgaattatgtgggcgctgctactgttgagtatttgtacagtatggaaactggcgagtactattttctagagctcaaccctcggttacaggtataaatgaatatagtttgtagggatgtgaagttgttatgctctatagtagtaatgatatctaaaatgcttaaattttatgttgctcaattgatgacaattggataaaccgtattcacttgggaaaaaccatcctgaatatagttcgtacctcattcaccttgcgtactactgatattgatcctatgaatctgttttttaaaatatctttgtttctgtaataaattgttctttgacttttctaatgatctttaatctacatcctaatctggatgtaggtggagcatcctgtcacagagtggattgctgaaataaatttgcctgctgcccaagtagctgttgggatgggaattcctctgtggcaaattcctggtatgaccgcaaaagttggaaattcgcattctcttgctcattagacatgtttctttgacattctgttcatttttattcagagattaggcgattttatggaatggaacatggtggaggatatgatgcttggaggaaaacttcagtggctgctacgccttttgattttgacaaggtagactctacaaagccaaaaggtcattgtgtagctgtacgtgtgacaagtgaggatccagatgacggtttcaagcctactagtggaaaagtactggtaaggttttcaggttgactattctaatttgaatttccttctattccaaaattccttatcctgtaatgaacttgtacttttattgtcttgcacaggagctgagttttaaaagcaagccaaatgtgtgggcttatttctctgtgaaggtgactttttgctgctctctttctttggaacatgtttatgttgacacaattggtttctgacttaataacttcattctgatttgtagtctggtggaggcattcatgaattctcagattcacaatttggtaagtaataattgctaaataatcacacttcatggataataatgaaaagaagtttgtgagatgagttatccaatctgctgcaaattaatggttcttttttatcttcttgtgacattttttttaacaaaagctacagtctgcttttcagtttagtcttttccgtttgttacatttgctatcgaaagcactcatgattgtcgtaatctttccttaggacatgtttttgcatttggggagtccagagctttggcaatagctaatatggttcttgggctgaaggaaatacagataagaggagaaatccgcaccaatgttgactactctgttgaccttttacatgtaaactatcttagctgttgatgttccctttatacatcatgtaaactttcacgaggaacatgaacacgagttgacatgctatgcaggcttcagattatagggaaaataaaattcacacaggttggttggacagtagaatagctatgagggttagagcagaaagacctccttggtacctctctgttgttggaggggcactatatgtaagttgtcacgatttcacatgagaggatgactgtatacttttggaatgctttattatgtctttcagaacttgccacttaagtgttcaattttttgtttgcaccagaaagcatctgctagcagcgcagctatggtttctgattatgttggttaccttgaaaagggccaaatccctcccaaggtacatcaaaagtatatttgtacaattgtatatgtttcttattcagccgattatgttgatgttgatgttgatgttagttgatcttgttttcagcacatatcacttgtgaactctcaagtttcattgaacatcgaaggaagcaaatatacggtatggtacctttcatattagtatcttaaatgaataaattttagtttggtgatggatgccatttacgtttgtaaaatcattgctagattgacatggttagaggggggccagggagctatagattgaggatgaatggatcggagatagaggcagaaattcatacactgcgtgatggaggtttattgatgcaggcaagttgactcattaaccatggctgttgtaaactaataattttcgtcctttttatcatttaatatttgctttagtcgaccctccatgctttggagaccataacagactctattctgtttcttcacagttagacggaaacagtcatgtaatatatgctgaagaagaagcagccggaactcgccttctaattgacgggaggacttgcttgctacagaatgatcatgatccgtcaaagttagtggcagagacaccatgcaaacttctgagatatttggtttcagatggtagtcatattgaagctgatgctccatatgcagaggttgaagttatgaagatgtgcatgcctcttctttcacctgcttctggagttgtccattttaaaatgtctgaaggtcaagcaatgcaggtgtgtttgatttcacaaacacgtgcttttgggcttgataagtactttttagttttatatgaatagtcagttttgatgtgaatctaagaagttttcatgtaggctggggagctcattgcaaggcttgatcttgatgatccttctgctgtaagaaaggcagagccttttcatgggagattcccgctacttggctctccgactgctatttctggtaaagttcatcagagatgtgctgcaagtttgaatgcagcccgtatgattcttgctggctatgatcataatattgatgaagtaagttgcaagctggctagtttcaacatgaacttaattgatgaattaattgttcattctatattttgttgattgtgtaatttcataacaaaataatgaactatgcatttggtttattatactgacaattatttgttgaaatctgatgtaatatctcaatgacatctataggtagtgcaaaacttgctcaattgccttgacagtcctgaactccctttccttcagtggcaagagtgcttgtctgttctagcaactcgccttcccaaggatcttagaagcgaggtgaataatttttctgtaattttttcatgaccacatagtcttcttgctcacaatttgatattggcaatttgtatagttggaatcaaaatacacagagtttgaaggaatttcaagctcccagaacattgacttccctgccaaactgttaaggggtgtcctcgaggtgggttccttattgcatggctctcttggaatttctcattatctgttttttttgctgtttaatgagatgtgtatgcttttcctccaggcacacctgaaatcctgtcctgagaaagaaaaaggagccctggaaaggcttgttgaacctttgatgagtcttgtaaagtcttatgagggaggacgtgagagtcatgctcgagtgatcgtccaatcactttttgaagagtatttatctgtagaagaattatttagtgacaacatccaggttagcttcttcctatcaaacataatatggaattattttggattctgaaagtcttccctctttggcatcttttagaaaattaagcataatactaggtactatatccattattctttataatcatgaaatttaatttttacagaagaaaagtggaatttctatatatatttaaaccaagctggcaagctttgaattcaatcctgttgtttattgttttatccaacatgccaaaaatattaggaacttcatgtgactacttgtatcattcttattctgtaattacagtaaagtaacttgtcatatcctaatgttataactcgtaacattcttctttaggctgatgtgattgaacgtctcagacttcaatataagaaagaccttttgaagatagtggacattgtcctttctcatcaggtatctgattttcggttttaatttttatctcgggttttctaaaatagaattctgagtttgtggaaataactaccgtatttgttggtttatagggtgttaagagtaaaaataagctgatactacggctcatggaacaacttgtttaccccaaccctgctgcatatagggataaactcattcggttctctcagcttaaccacaccagctattccgaggttggcagctatacttggtccatctgtaatttcataaagttgttgctctgtttccttttgttcacaagttcatttttgagagttttccataggatggtgactgacaggaagaggattctaatgttttctcttggaggattttttctgtattttcatttcttgtcggtcattgattaattccgtttctggtatcagtatcatcaaaatgttgtctttttctgtatactgatgctgaattatgtgaacagttggcattgaaggcaagtcaactcctagaacaaaccaaactgagtgaactccgttccactattgctagaagcctttcggaattggagatgtttaccgaggatggtgaaaatatggatactcccaaaaggaaaagtgccattaatgaacgtatggaggatcttgtgagtgctcctttggctgttgaagatgctttagtgggtcttttcgagcacagtgatcacacccttcaaaggcgagtggtggaaacttatgttcgtaggctatatcaggtactgtgttgtagaaacttaaaacttttatctggtgatcaaacactagacgaaacttgatcttgatcaactgtttgtctaccgcaccagccctatctggtcaaaggtagtgtcaggatgcagtggcatagatttggtcttattgctacatgggaattcttgggagagcatatcgggagaaagaatggatctgaaggtcaaatgtcagatgaaccagaggctaaaaaacagtctaataagagatggggagcaatggttatcatcagatctctgcagtttttgccttcagttattggtgctgcattaagggaaacaaatcaaagccttaatgagtccattccaagtggattagtaaaatcagcgagctttggtaatatgatgcacatagcattggtaggcatcaataatcagatgagcttactacaggataggtaacttccttcggtactataatataagcgtttattttaatcataaaaattagtagcattttacattctattattcattgtaagatctcaagtcttcttaatcatttctgcatttgaaaccttgatagatctggatagattccttatttttgtttaaaatttatgatagagttacctggtctcgaacccttaaaacatgcacatatattggcttgccaaacataagttattttgcgttgtcaatttcgattattgacggtcagcttgttaatgctcctaactggcaccatctatgacattttgcagtggtgatgaggatcaggcacaagagagaattaacaagttagccaaaattctcaaagaacaggaactaggttccagtttgagcttgtcaggcgttggagttattagctgtatcatacagagggatgaagggagagcccctatgaggcactcctttcactggtcagaggaaaagctttattatgaggaagaacctctattgcgacatttggaacctccactatccatctaccttgaactggtttgtcacctatcgcagtgtttcaatacatttttttggcagaaacctttattgagcccctgaacttaccagttttattctcaagttattatttgactacattaaatacttaattactattgattccacattatgaccttgcaatataattacaagtgttacgttttattgataaaattataactgttgctattttgttttacatatatcaaggactgcactatagtaaaaaaatgaggactcgataggattggaaagttcaggggcttactaattgtttgagcggaaaaaaatatatataaatgtgaaattggataattctatatcattcatctgaagcttattatggcctttttttgatccaggacaaacttaaaggctatgacaatagacaatatactcagtcaagggacagacaatggcacatgtacactgttgtagacaaaccagttccaatccagaggatgtttctaagaacccttgtgagacagcccacaagtacttcatatcaaggtcttggcgccgaagcacccaatgtgcagtgggccatgtcctttacgtcaaagagcattttgaggtccttagtagctgcaatggaggaactggagcttcacgtgcacactgtcaaatctgaccatgctcatatgtacctctgcatattgagggagcaacggatagaagatcttgttccatacacgaagtaattatatcaatctttatgatttattgtgtacttggcaccataactttatgtgtactcactatgagactccatctccaggaaaaccgatgtagatgccaaccaagaagaagctgcggtagcaagaatcttggaagaactagcgaggaagatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatgtaagtatctgcgcatcttatttcaagaaaatgtctttcccttccatgcattccttattagtcgacttagtaatggggaatgtcgagaagtgttggatggttaccaatgtgagtaccatcactgtttagattaaaattgaccattgctttagcaatacaataatgaatctaattgtggcatgggaggcttttctatgtgtgatccatggaaaaacttgtatatagttccttagtaggtttgagttgttttcatttttcttttatcacattgtaattgtattggtgattgatacgaaaattagatatatcgggaacttggggacgagagcaaacatgaagtggtgtaccattcaatctctccaagaggcccactgcatagcatgccagtgaatgctgtttatcagcccttgggagttctcgatcgaaaacgtttgttggcaaggaagagcaacaccacttactgctatgattttccactggttagtatttctataatcattaatcaaacatcagtttttttattggggataattaaaatcaaataatttttcctggcctcatccttttcaggcgttcgagacagccatcgaacaattatgggaatctcaatcaccagggactgaaagaaacaaagaaaaagtcctaaaagtctcggagcttgtttttgccgatcagaaaggtacctggggaactccacttgttcatgcagaacggccagctgggcttaacgacgtgggcatggtagcatggtgcatggaaatgttcaccccggaatgcccttccggaaggaaaatcttgatagtagcgaacgacgtgaccttcaaagccgggtctttcggcccgagagaggatgcattcttttccgccataaccgatcttgcatgcaccaaaaagctccctttagtctacctggcagcaaactctggtgctcgtataggtgttgccgaggaagtcaagtcttgctttaaagtcggttggtcagatgagtcatctcccgagcgtggtttccagtacgtatatttgactcccgaggattatgtaaccattggatcatcggtgatagcacacgagctgaatcagaatggagaaacacggtgggtcatagatgccattgttgggaaagaggatggcttaggtgtcgaaaatttatcgggaagtggagccattgctagtgcatactcaagggcatataaggaaaccttcacattgacatacgtaactggaagaacagtgggaatcggtgcttacctggcacgcctcgggatgagatgcatacaacggctcgatcaaccgatcatcttgaccgggttctccgcgttaaacaaactcctcggccgtgaagtgtatagctctcacatgcaactcggcggtccgaaaattatggccaccaatggggtagtccatcgcaccgtctccgatgacctcgaaggtatttcggaaatcctgaaatggctaagctgtattccccctcaaagcggcggggcaattccggtatttccttctccggatcctccggagcgacccgtggagtacttcccagaaacatcgtgcgacccgcgggcggccatctcgggtacaatggacggcagcgggaagaagtggctcgggggtattttcgacaaagacagcttcgtggagacactggaagggtgggcgaggaccgtggtgaccgggcgggcaaagctcggggggattccggttgggataatagccgtcgagactcaaaccgtgatgcaagtgatccccgccgacccgggccagctggactcgcacgagcgggtcgtgccccaggcgggtcaagtatggttcccagattcggcgaataaaaccgcccaagcgattatggatttcaaccgagaagagctcccgctctttatcctcgccaactggcgaggcttctcgggcggccaacgagacctcttcgaaggtatcctacaggcggggtccaccatagtggaaaacttaaggacatataaccaaccggttttcgtatacatccctatgatgggcgagcttcgtggtggggcctgggttgttgtggacagtcagataaattccgaccacatcgagatgtacgctgatcggacggctaaaggcaacgtccttgaaccggaaggaataatcgagatcaagtttagaacaaaggagttgctcgattgcatgaatcgactcgacccaaagctgatatctttaaaaaccaaactaaccgaagcgaagaatagtgggacctacgggatggtcgattccgtacaacagctgataaaatcccgggaaaagcaacttctgccgctttacacgcaaatcgccacacgattcgccgagcttcacgactcggctttacgaatggcggcaaagggggtgattcgagaagttgtcgactgggggatttcacgatcttacttctacaaaaggttaagaaggagaatcgccgaggcttcgttggtgaacaccgtgaaagatgcagcgggtgataagctccagcataagtcggctatggagttggtcaaaaactggtttctggactcgaaaggcgattgggaaaacgatgaagctttctatgcttggaaggataatcccgcgaattacgaggaaaagctacaggagttacgggtccagaaggtgttgcttcagttaactaacattggcgagtctttgtcggatttgaaagctttacctcaaggtcttgctgcccttctaaataaggtaattttttgggttttttcttccaggaatattgtttatttagacgatcgagtcggatgttatgtaatactttatgtttgatgtaggtggagccatcgagccgaggggcgttgatcgatgagcttcggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtgaatagggggaattagttcatatgattattgttgttataaacaaatcagagatagagagagctatatttattattatatttgcgaattaaagttattaggagtagtataatttggcggttgttgcattttacgtgtaatgatctgaatgttgtttgttcgtgattattgaataaaagggcatcaaatgccataatttatctttctttgttaacaagattttaattagttttttttaattattagtatgttttgtataatttatatt

SEQ ID NO: 58 - DNA, 5227 bp, Euphorbia heterophylla
tatataaatgtgaaattggataattctatatcattcatctgaagcttattatggccttttttgatccaggacaaacttaaaggctatgacaatagacaatatactcagtcaagggacagacaatggcacatgtacactgttgtagacaaaccagttccaatccagaggatgtttctaagaacccttgtgagacagcccacaagtacttcatatcaaggtcttggcgccgaagcacccaatgtgcagtgggccatgtcctttacgtcaaagagcattttgaggtccttagtagctgcaatggaggaactggagcttcacgtgcacactgtcaaatctgaccatgctcatatgtacctctgcatattgagggagcaacggatagaagatcttgttccatacacgaagtaattatatcaatctttatgatttatcgtgtacttggcaccataactttatgtgtactcactatgagactccatctccaggaaaaccgatgtagatgccaaccaagaagaagctgcggtagcaagaatcttggaagaactagcgaggaagatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatgtaagtatctgcgcatcttatttcaagaaaatgtctttcccttccatgcattccttattagtcgacttagtaatggggaatgtcgagaagtgttggatggttaccaatgtgagtaccatcactgtttagattaaaattgaccattgctttagcaatacaataatgaatctaattgtggcatgggaggcttttctatgtgtgatccatggaaaaacttgtatatagttccttagtaggtttgagttgttttcatttttcttttatcacattgtaattgtattggtgattgatacgaaaattagatatatcgggaacttggggacgacagcaaacacgaagtggtttaccattcgatctctccaagaggcccactgcatagcatgccagtgaatgctgtttatcagcccttgggagttctcgatcgaaaacgtttgttggcaaggaagagcaacaccacttactgctatgattttccactggttagtatttatataatcattaatcaaacatcagtttttttattggggataactaaaatcaaataatttttcctggcctcatccttttcaggcgttcgagacagccatcgaacaattatgggaatctcaatcaccagggactgaaagaaacaaagaaaaagtcctaaaagtctcggagcttgtttttgccgatcagaaaggtacctggggaactccacttgttcatgcagaacggccagctgggcttaacgacgtgggcatggtagcatggtgcatggaaatgttcaccccagaatgcccttccggaaggaaaatcttgatagtagcgaacgacgtgaccttcaaagccgggtctttcggtccaagagaggatgcattcttttccgccataaccgatctggcatgcaccaaaaagctccctttagtctacctggcagcaaactctggtgctcgtataggtgttgccgaggaagtcaagtcttgctttaaagtcggttggtcagatgagtcatctcccgagcgtggtttccagtacgtatatttgactcccgaggattatgcaaccattggatcatcggtgatagcacacgagctgaatcagaatggagaaacacggtgggtcatagatgccattgttgggaaagaggatggcttaggtgtcgaaaatttatcgggaagtggagccattgctagtgcatactcaagggcatataaggaaaccttcacattgacatacgtaactggaagaacagtgggaatcggtgcttacctggcacgcctcgggatgagatgcatacaacggctcgatcaaccgatcatcttgaccgggttctccgcgttaaacaaactcctcggccgtgaagtgtatagctctcacatgcaactcggcggtccgaaaattatggccaccaatggggtagtccatcgcaccgtctccgatgacctcgaaggtatttcggaaatcctgaaatggctaagctgtattccccctcaaagcggcggggcaattccggtatttccttctccggatcctccggagcgacccgtggagtacttcccagaaacatcgtgcgacccgcgggcggccatctcgggtacaatggacggcagcgggaagaagtggctcgggggtattttcgacaaagacagcttcgtggagacactggaagggtgggcgaggaccgtggtgaccgggcgggcaaagctcggggggattccggttgggataatagccgtcgagactcaaaccgtggtgcaagtgatccccgccgacccgggccagctggactcgcacgagcgggtcgtgccccaggcgggtcaagtatggttcccagattcggcgaataaaaccgcccaagcgattatggatttcaaccgagaagagctcccgctctttatcctcgccaactggcgaggcttctcgggcggccaacgagacctcttcgaaggtatcctacaggcggggtccaccatagtggaaaacttaaggacatataaccaaccggttttcgtatacatccctatgatgggcgagcttcgtggtggggcctgggttgttgtggacagtcagataaattctgaccacatcgagatgtacgctgatcggacggctaaaggcaacgtccttgaaccggaaggaataatcgagatcaagtttagaacaaaggagttgctcgattgcatgaatcgactcgacccaaagctgatatctttaaaaaccaaactaaccgaagcgaagaatagtgggacctacgggatggtcgattccgtacaacagctgataaaatcccgggaaaagcaacttctgccgctttacacgcaaatcgccacacgattcgccgagcttcacgactcggctttacgaatggcggcaaagggggtgattcgagaagttgtcgactgggggatttcacgatcttacttctacaaaaggttaagaaggagaatcgccgaggcttcgttggtgaacaccgtgaaagatgcagcgggtgataagctccagcataagtcggctatggagttggtcaaaaactggtttctggactcgaaaggcgattgggaaaacgatgaagctttctatgcttggaaggataatcccgcgaattacgaggaaaagctacaggagttacgggtccagaaggtgttgcttcagttaactaacattggcgagtctttgtcggatttgaaagctttacctcaaggtcttgctgcccttctaaataaggtaattttttgggttttttcttccaggaatattgtttatttagacgatcggagtcggatgttatgtaacactttatgtttgatgtaggtggagccatcgagccgaggggcgttgatcgatgagcttcggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtgaatagggggaattagttcatatgattattgttgttataaacaaatcagagatagagagagctatatttattattatatttgcgaattaaagttattaggagtagtataatttggcggttgttgcattttacgtgtaatgatctgaatgttgtttgttcgtgattattgaataaaagggcatcaaatgccataatttatctttctttgttaacaagattttaattagttttttttaattattagtatgttttgtataatttatatttgactaattaatgagttctttctgaatttataccaaaatttcaatataatactgaatttaaaacttgagtctagattaccaacaaggtgtagctcagttggcaacgcaggctgggtaagttggaggagaacaatgtttgaatcctactaaatacacttgttgggaggggtgatgagccttaactgtgattaagtcccgaacaagattatctcaatggtgatacttgtaattattaccaaaaaaaacttgagtctacgatgcaaatatgtattatctaggcatggtctaattagatttaaatatgggctgattggatttaaatttctctttttttagtacgatcttattaattcaaattagagtccattacatttctaatggatgagaaaccacgtcctcctctatgtcaaagaaatagatgtcttggctaataaatggacaacttgattcgtagacctattaacaaaaacaacttttaaacctaaaaaagaggtcatgagtattttgcaatcgaaaatagtgaaacctattgacgaatgaagaggagagttgatcagagcatatagctcgagaatgacactatccaagccttggctctttagtcaactgagcgcctctctgcaactcatagcctctactagaagaacatcttgcatgagagaggattgggctgctacaaatctacccatataatctcgaattacacagccattcatctaccattctcaaacacactagcacgttacatttaaatccaatgttgttttagctttggatgttttgtgtgtcattaatgtttgttgtctgccattcactgaggaaccccaaactgtgcctaataacttgggaatcaattcgaaaacgttgattccaagcccagctattccttctgggaccatatagtgcacaaaatcaaatccaccaatctgtgatggaagctatcgaatatggccacccattgctgcaaatgcccgaccataacgcgagagcaaatggtcaggtaacgagggcgtgataagtcaatgtgtcgtgtcagccccatcactgcatatagaaccaacatggtcgatcataatatgcttatcttgaagcctaaccaacgttggtaatgggagtcccaccatcgctactttccaaaaaaagatgagtacatgagctgggaattggatgtcccgaatttttagattaaatatatcaacattataaatttctttttttttttttataaattaacattataaattcaatcaaaatgataatcgttctatgat

SEQ ID NO: 59 - DNA, 4102 bp, Euphorbia heterophylla
atgttagttgatcttgttttcagcacatatcacttgtgaactctcaagtttcattgaacatcgaaggaagcaaatatacggtatggtacctttcatattagtatcttaaatgaataaattttagtttggtgatggatgccatttacgtttgtaaaatcattgctagattgacatggttagaggggggccagggagctatagattgaggatgaatggatcggagatagaggcagaaattcatacactgcgtgatggaggtttattgatgcaggcaagttgactcattaaccatggctgttgtaaactaataattttcgtcctttttatcatttaatatttgctttagtcgaccctccatgctttggagaccataacagactctattctgtttcttcacagttagacggaaacagtcatgtaatatatgctgaagaagaagcagccggaactcgccttctaattgacgggaggacttgcttgctacagaatgatcatgatccgtcaaagttagtggcagagacgccatgcaaacttctgagatatttggtttcagatggtagtcatattgaagctgatgctccatatgcagaggttgaagttatgaagatgtgcatgcctcttctttcacctgcttctggagttgtccattttaaaatgtctgaaggtcaagcaatgcaggtgtgtttgatttcacaaacacatgcttttgggcttgataagtacattttggttttatatgaatagtcagttttgatgtgaatctaagaagttttcatgtaggctggggagctcattgcaaggcttgatcttgatgatccttctgctgtaagaaaggcagagccttttcatgggagattcccgctacttggctctccgactgctatttctggtaaagttcatcagagatgtgctgcaagtttgaatgcagcccgtatgattcttgctggctatgatcataatattgatgaagtaagttgcaagctggctagtttcaacatgaacttaattgatgaattaattgttcattctatattttgttgattgtgtaatttcataacaaaataatgaactgtgcatttggtttattatattgacaattatttgttgaaatctgatgtaatatctcaatgacatctataggtagtgcaaaacttgctcaattgccttgacagtcctgaactccctttccttcagtggcaagagtgcttgtctgttctagcaactcgccttcccaaggatcttagaagcgaggtgaataatttttctgtaattttttcatgaccacatagtcttcttgctcacaatttgatattggcaatttgtatagttggaatcaaaatacacagagtttgaaggaatttcaagctcccagaacattgacttccctgccaaactgttaaggggtgtcctcgaggtgggttccttattgcatggctctcttggaatttctcattatctgttttttttgctgtttaatgagatgtgtatgcttttcctccaggcacacctgaaatcctgtcctgagaaagaaaaaggagccctggaaaggcttgttgaacctttgatgagtcttgtaaagtcttatgagggaggacgtgagagtcatgctcgagtgatcgtccaatcactttttgaagagtatttatctgtagaagaattatttagtgacaacatccaggttagcttcttcctatcaaacataatatggaattattttggattctgaaagtcttccctctttggcatcttttagaaaattaagcataatactgggtactatatccattattctttataatcatgaaatttattcttacagaagaaaagtggaatttctatatatatttaaaccaagctggcaagctttgaattcaatcctgttgtttattgttttatccaacatgccaaaaatattaggaacttcatgtgactacttgtatcattcttattctgtaattacagtaaagtaacttgtcatatcctaatgttataactcgtaacattcttctttaggctgatgtgattgaacgtctcagacttcaatataagaaagaccttttgaagatagtggacattgtcctttctcatcaggtatctgattttcggttttaatttttatctcgggttttctaaaatagaattctgagtttgtggaaataactaccgtatttgttggtttatagggtgttaagagtaaaaataagctgatactacggctcatggaacaacttgtttaccccaaccctgctgcatatagggataaactcattcggttctctcagcttaaccacaccagctattccgaggttggcagctatacttggtccatctgtaatttcataaagttgttgctctgtttccttttgttcacaagttcatttttgagagttttccataggatggtgactgacaggaagaggattctaatgttttctcttggaggattttttctgtattttcatttcttgtcggtcattgattaattccgtttctggtatcagtatcatcaaaatgttgtctttttctgtatactgatgctgaattatgtgaacagttggcattgaaggcaagtcaactcctagaacaaaccaaactgagtgaactccgttccactattgctagaagcctttcggaattggagatgtttacagaggatggtgaaaatatggatactcccaaaaggaaaagtgccattaatgaacgtatggaggatcttgtgagtgctcctttggctgttgaagatgctttagtgggtcttttcgagcacagtgatcacacccttcaaaggcgagtggtggaaacttatgttcgtaggctatatcaggtactgtgttgtagaaacttaaaacttttatctggtgatcaaacactagacgaaacttgatcttgatcaactgtttgtctaccgcaccagccctatctggtcaaaggtagtgtcaggatgcagtggcatagatttggtcttattgctacatgggaattcttgggagagcatatcgggagaaagaatggatctgaaggtcaaatgtcagatgaaccagaggctaaaaaacagtctaataagagatggggagcaatggttatcatcagatctctgcagtttttgccttcagttattggtgctgcattaagggaaacaaatcaaagccttaatgagtccattccaagtggattagtaaaatcagcgagctttggtaatatgatgcacatagcattggtaggcatcaataatcagatgagcttactacaggataggtaacttccttcggtactataatataagcgtttattttaatcataaaaattagtagcattttacattctattattcattgtaagatctcaagtcttcttaatcatttctgcatttgaaaccttgatagatctggatagattccttatttttgtttaaaatttatgatagagttacctggtctcgaacccttaaaacatgcacatatattggcttgccaaacataagttattttgcgttgtcaatttcgattattgacagtcatcttgttaatgctcctaactggcaccatctatgacattttgcagtggtgatgaggatcaggcacaagagagaattaacaagttagccaagattctcaaagaacaggaactaggttccagtttgagcttgtcaggcgttggagttattagctgtatcatacagagggatgaagggagagcccctatgaggcactcctttcactggtcagaggaaaagctttattatgaggaagaacctctattgcgacatttggaacctccactatccatctaccttgaactggtttgtcacctatcgcagtgtttcaatacatttttttggcagaaacctttattgagcccctgaacttaccagttttattctcaagttattatttgactacattaaatacttgaattactattgaatccacattacgaccttgaaaacgttttattgataaaattataactgttgctattttgttttacatatatcaaggactgcactatagtaaaaaaatgaggactcgatatgattggaaagttcaggggcttactaattgtttgagcggaaaaaaatatatataaatgtgaaattggataa

SEQ ID NO: 60 - DNA, 1523 bp, Euphorbia heterophylla
aaaatatctttgtttctgtaataaattgttctttgacttttctaatgatctttaatctacatcctaatctggatgtaggtggagcatcccgtcacagagtggattgctgaaataaatttgcctgctgcccaagtagctgttgggatgggaattcctctgtggcaaattcctggtatgaccgcaaaagttggaaattcacattttcttgctcattagacatgtttctttgacattctgttgatttttaatcagagattaggcgattttatggaatggaacatggtggaggatatgatgcttggaggaaaacttcagtggctgctacgccttttgattttgacaaggtagactctacaaagccaaaaggtcattgtgtagctgtacgtgtgacaagtgaggatccagatgacggctttaagcctactagtggaaaagtactggtaaggttttcaggttgactattctaatttgaatttccttctattccaaaattccttatcctgtaatgaacttgtacttttattgtcttgcacaggagctgagttttaaaagcaagccaaatgtgtgggcttatttctctgtgaaggtgactttttgctgctctctttctttggaacatgtttatgttgacacaattggtttctgacttaataacttcattctgatttgtagtctggtggaggcattcatgaattctcagattcacaatttggtaagtaataattgctaaataatcacacttcatggataataatgaaaagaagtttgtgagatgagttatccaatctgctgcaaattaatggttcttttttatcttcttgtgacattttttttaacaaaagctacagtctgcttttcagtttagtcttttccgtttgttacatttgctatcgaaagcactcatgattgtcgtaatctttccttaggacatgtttttgcatttggggagtccagagctttggcaatagctaatatggttcttgggctgaaggaaatacagataagaggagaaatccgcaccaatgttgactactctgttgaccttttacatgtaaactatcttagctgttgatgttccctttatacatcatgtaaactttcacgaggaacatgaacacgagttgacatgctatgcaggcttcagattatagggaaaataaaattcacacaggttggttggacagtagaatagctatgagggttagagcagaaagacctccttggtacctctctgttgttggaggggcactatatgtaagttgtcacgatttcacatgagaggatgactgtatacttttggaatgctttattatgtctttcagaacttgccacttaagtgttcaattttttgtttgcaccagaaagcatctgctagcagcgcagctatggtttctgattatgttggttaccttgaaaagggccaaatccctcccaaggtacatcaaaagtatatttgtacaattgtatatgtttcttattcagccgattatgttgatgttgatgttagttgatcttgttttcag

SEQ ID NO: 61 - DNA, 1349 bp, Xanthium strumarium
gttgttgtcaagtctctatttgaggagtatctgtctgttgaagaactcttcaatgataaccttcagtctgatgttatagagcgtctacgtcttcaacatgcaaaagaccttgagaaggttgtacacattgtgttctcgcaccagggtgtgagaaacaaaaataaattaatactacggcttatggaagcattagtatatccaaacccatctgcttacagagaccagttgattcgcttctctgccttgaaccatacatcttattctgagttggcacttaaagcaagccaacttctagagcatactaaattgagtgaacttcgaacaagcatagcaagaagcctttcagagttggagatgtttactgaggaaggagaacgggtgtcaacacctaggagaaagatggcaataaatgagaggatggaagatttagtatgtgctccactggcagttgaagatgctcttgtagctttgtttgatcacagcgatcctacacttcagcggagggttgttgagacatatatacgtcgattgtatcagccctaccttgtaagtggaagtatccggatgcaatggcaccgagctggcttaattgctttatgggagttctctgaagagcatcttaagcaaagaaatgggcacgatgtgcttgtacagcaagtagagaatcccattgagaagagatggggtgtcatggttgtaatcaagtctcttcagtttctagcaactgcaattgatgctgcactgaaggagacctcgcaatatagagcaggtgctgtaagtgtctcgaatggtaaccatgtaaattcaaatcaaagcaatatgctgcatattgctttggttggtatcaataatcagatgagtactctccaagacagtggtgacgaggatcaagcacaggaaaggatcaacaaactatccaaaattttgaaggataatactattacatcgcaacttaatggtgctggtgttaaggtcgtcagttgcattatccaaagagatgaagggcgtccaccaatgcgacactccttccattggtctgttgacaagctttattatgaggaggatccaatgctccgccacgtggaaccaccattgtctacattccttgagctggacaaagtaaatttggagggttacactgaagtaaaatacaccccatcacgtgatcgtcagtggcatatttacacacttatcaagaacaagaaagatcagagattaaacgaccagaggatgttccttcgtaccatagtcagacaacaaagcgcaacaaatggtttcctgtcaggaaatattgacaatgaagtaggccgcactcaagcttcgtcattcacatcacacagcatcctcag

SEQ ID NO: 62 - DNA, 7098 bp, Commelina diffusa
atgacactgattaaatatctatgtagaacgcctgaagcccagaagggagcagttatggcagatgtctggcaagatcatgggattttaaatgggacagttcaagtcaaacatgcagctacaacgtctgaagttgatgatttctgttatgcacttggtggaaagagacctattcgcagcatattgattgctaataatggaatggctgctgtcaaattcatgcgtagtattagaacctgggcttacgaaacatttggatcagaaaaggcaattttgttggttgcgatggcaactccagaagacttgaggataaatgccgagcacattagaattgctgatcaatttgtagaggttcccggtggaaccaataataacaattatgcaaatgttcaactcattgtggagctggccgaaataacacgtgtttctgcagtttggcctggatggggccatgcatccgagaatcccgaacttccagatgccctgaatgcaaagggaataatctttctcgggcctccagctgcgccaatgtcagcactaggtgataaaattggttcttctctaattgctcaggcagcaggtgtaccaactcttccgtggagtggctcacatgtcaaaatttcagcggaaagttgtatggacacaatacccgaagagatatacaagcaggcttgtgtttatacaacagaagaagcagtggccagctgccaggtagttggctatcctgccatgataaaggcatcttggggcggtggtggtaaaggaataagaaaggttcacaatgacgatgaagtgagagctctcttcaaacaagtgcaaggagaagttccaggatctccaatatttataatgaaagtggcatcacagagtcgtcacttggaagttcagttgctttgtgatgaatatggcaatgttgctgctcttcacagtcgagattgcagtgttcaaaggcgacaccaaaagatcatcgaagaaggtccgatcacggtggcccctcctgagacagtcaaacaacttgagcaggcagcaagaaggcttgctaagtgtgttggttatgttggtgctgctactgttgaatatctctacagtatggaaactggtgactactatttcctagaactgaaccctcgattacaggttgagcatcctgtaactgagtggatagctgaagtcagcttgcctgcggctcaagtttcagttggtatgggcataccactatggcaaattccagaaatcagaagattttatggaaaggagcatggtggaggatatgatgcttggaggaagacatcactttctgcaagtccttttgactttgacaaagcagagtctacaaggccaagaggtcattgtgtagctgttcgtgtgacgagtgaagatccagatgatggcttcaagcccaccagtggcaaagtgcaggagctaaattttaaaagcaagcctaatgtgtgggcatacttctctgttaagtctggtggtggcatccatgaattttctgattctcaatttggacatgtttttgcatttggggaatctagagccttggcgatagctaacatggttcttggactgaaggagatccaaattcgtggggaaattcgaacaaatgttgattacacaattgatctattaaatgcatcagaatacagagacaacaaaatccacactggttggctggatagcagaatagcaatgagggtcagagctgagaggcctccatggtacctttcagttgttggaggagctctttataaagcaacaactagcagtgctgccattgtttccgaatatgttggttatcttggtaaaggtcaaatcccaccaaagattgaaatggttcgaggtggacctggtagttataaattaaaaatgaatggttcagagattgaagctgaaattcatactctccgtgatggtggacttctgatgcagctagtttcagtggcaaagcaagcattccaatatgctaagcctgttaacagtattgatgctgctgtaaaattgccccgtatgaatttccagtcttcttcatactctatttttcttaataagataatgtaccgacaacttgatgatggaagctttttggatggaaacagccatgtgatatatgctgaagaggaggctgctggtacacgccttcttatcgatggaaggacttgcttgttacagaatgatcatgatccatcgaaattgattgcggagacaccatgcaaacttcttcgctacttgattgctgatggagagcatcttgatgctgatgcaccatatgcagaggtcgaagtaatgaagatgtgcatgccccttttgttacctgcttctggagttattcattttgtgatgtctgaaggtcaggctatgcaggctggtgacctcatagcaaggctcgacttagacgatccatctgctgtaagaagagctgaaccattcaatggtacattccctaaagtaggtcctcccactgcagtttctgacagagttcaccagagatgtgctgcaagtttgaatgctgcacgcatgattcttgcaggatatgaacataatattaatgaagttgttcaagagttactacattgtttggatagtccggagcttccttttctacagtggcaggaaagtatgtctgtattggcaactcgcctgccgaaagaacttaaaaatgagttggattctaaatacaaagtatttgaaacaaactcaaacgttcaaaagaatgtggaatttcctgccaagcttctgagtggagttattgagagctatctctcatcttgtagtgagaaagataaggcggcacaggaaaggcttgtggaaccacttctgagccttgcgaagtcatacgaaggtggaagagaaagccatgctcgtgtaattgtgcattctctttttgaagagtacttatctgttgaagagttattcagtgatagcattcaggccgatgtcatagaacgcctacgacttcaataccagaaggatcttctgaaagttgtagacatagtgctgtctcatcagggtgttagaagtaaaaataagctgatactgaggttgatggaagcattggtctatcctaatcctgctgcctatcgggaacaactgattcgcttctctgctcttaaccataccacttactccgagttagcattgaaagccagtcaactccttgaacaaactaaattgagtgagcttcgaacaagcattgccagaagcctttccgagctagaaatgtttacagaagaaggtgaacgtctatctacaccgagaaggaaaagtgctatcaatgagaggatggaggatcttgtaagtgctacgctggccgttgaagatgcacttgtgtctttgtttgatcacactgatccaactgttcagagacgagtgatggaaacatatgtccgaagattgtaccagccctaccttgtgaaggatagtgtccgaatgcagtggcaccgttctggtttgatcgcgacatgggaattcaccgaagaacatattgagaaaaagaatgattcttctacacaagataagtcatttatggagaaacattgtcaaaagagatggggagctatggttatcgtcaaatctctccagtttcttccagcagcaattagtgcagcattgaaggaaaccagtcatctgtcatctgatactgatcatgatacagtatctaatgggcttcctcaacatgctagtcaaggcaatatgcttcatgttgcattggttggcattaacaatcaaatgagtacacttcaggatagtggagatgaggatcaggctcaggagaggatacacaagcttgccaagattctaaaagataacaaggtagcgactgaactttccaatgctggagtccgagttgttagctgtattatacaaagagatgaaggacgaacacctatgcgtcactccttccattggtctgccgataagcaatgctatgaagaagaacccttgcttcgtcatctggaacctcctctgtctactttccttgaattggataagctgaaaggctacaaaaatatacaatacacaccatcacgggatcgccagtggcatatgtacacagttcaagaaactaaaccacttaatcagaggatgtttctgaggacccttgtcagacaaccaaggataaataatggattttcatcaaaccagcttcccgaattagaaactagacatgatttatcctttacatcagtcagcttgttgagatctttgatggcagcattggaagagttagaactacatgtccatagcgaaacaatcagatctgatcattctcacatgtatctctgcatattacaagaacaacaactctccgatcttttacctcgttcaggtactcttgatcctgatgcctatcagaatgaaagtcaagtgtccctgcttttaaaagatatggctgtcaggattcatgagatagttggtgtaaggatgcatcgtcttactgttattgagtgggaggtaaagctctggttgggttctgatggtgttgctggtggttcttggagggttgtggtgacaaatgttactggacgtacatgtaatgtccatatttaccgagaattggaggacagcaaatcacatgaagtggtctatcactctgcagcttcagtcacaggacctctccatggtatgccgttgattgctagatatcagccacttagtgttattgataaaaaacgatgggtggcaagaaggagcaacactacttattgctatgactttccactggcgtttgagacagcactgaagcagtcatgggcttcttatagtgatactaaagcaccagaaagcaaagctcttctccaagttcaagaacttatgtttgttgacaaaaagggatcatggggtactcctgttgaacctgtatgctgcccacctggtctcagtgatattggcatggttgcttggtcaatggaaatgtacacaccagaatttcccgaaggaaggaagattgttgttgtagccaatgatttgactttcaaagcaggctcctttgggcctcgtgaagatgcatttttccatgctgtaaccaattatgcatgtgataagaggctccctctaatctatttggcagcaaattctggcgccaggattggtgctgctgaagaggtcaagtcttgctttaaggttggatggtctgatgagtcgagtccagaacgtggttttcagtatgtgtatctgacacaggaggactataaccgtattggttcatctgttattgcacatgaactgaagcttgaaagtggtgagatcagatgggtgatcgacacaattgttggcaaagatgatgacttgggtgttgagaacctcactggcagtggtgcaattgccggtgcttattccagggcttataacgaggtatttactcttacatatgtgactggacgtactgtaggaatcggagcctatcttgctcggcttggcatgaggtgtatccagaggctagaccagcctataatcctaacagggttttctacactcaacaagttgcttggccgtgaggtgtacagctcacacatgcaactaggtggcccgaagatcatggctacaaatggtgttgttcatctgacggtatcagatgatcttgagggcgtttctgctattcttaagtggcttagttacgtaccaccctatgtcggtgggccacttccaataataaaatccttggatcccccagaaaggccagtggagtattttcctgaaaattcatgtgatccacgggccgcaatttgcggcattgatgatggcaatggcaagtggttaggtggtatgtttgataaagatagttttacggagacattagaaggttgggcaaagacggtggtcaccggaagagcaaagttgggtggaattccagtaggagttatagctgtcgagacacagactgtgatgcaagtcattcctgcagatcctggtcagcttgattcccatgaacgtgttgtcccacaagctggtcaagtttggttccctgattctgccaccaaaacggcacaagcattattagacttcaatcgtgaagaattgccacttttcatactagccaactggagaggattctcaggcggacagagagatctcttcgaaggtatacttcaggctggttccacaatcgtcgaaaacttaaggacatataagcagcctgtatttacctacatcccaatggccggggagcttcgtggtggtgcatgggttgtggtggacagcaaaatcaacccggatcacatcgagatgtatgccgaaagaacagcaaggggcaacgtacttgagcccgaaggaatgattgagattaagttcagaactaaagaacttctcgagtgcatgggtagacttgatcctgagctaatcagtttgaaaacaaagcttagggagttgaaggcagctggaccttccagagatgtggacgtcctccagaaaagtgtaacggctagagagaagcagttattgcctgtatatacacaaattgctataaagtttgcagagttgcacgatacatccttgcgaatggctgccaaaggtgtgatcaagaaagtggtagactgggagaactcccgttctttcttctacaaaaggttaaacaggagagtttccgaggatgtccttgcaaaaactgttagagatgctgctggggagcagttgtcgtacaagtctgctattgaactgcttaagcagtggttttcatcttccgacaatgtggacgttggaaaatgggaggaagacgatgctttccttgcctggaaagacaaccctaaaaattatgccaagtatcttgaagagctacgagttcagaagatattgcagcagctctcagctcttggtgaatcatcttcggatttgcgagtattgcctcaatgtcttgctacagtccttagcaagggcagaataacaaactcaagcgaatcggagaagagcaggaccgagcacgagatctggtcgactgagcttgagtgggccaagcttaagcttgcgatggagaagaagtgcgccagagaagaggggcacacctggataaggaaggcgagatacacgagcatgaccaaatcgaaaatgagctggaggggaagggaggaggagaataagggagacatgagaggaggggaaggataa

SEQ ID NO: 63 - DNA, 14748 bp, Commelina diffusa
aaaaaaaaaaaaaaacaaagatcttatgatagtctgaaaacaaactttgaccagtgtgattttatgttaagtgtatttacctatctttcaattgacttttcaggttcacaatgacgatgaagtgagagctctcttcaaacaagtgcaaggagaagttccaggatctccaatatttataatgaaagtggcatcacaggtgagataaatgtatttttaaagcttcagttatgtcatgaatttatatggccctgcattaactgaatctagactatgcccaatatgaaattattgcaggttactttaagcagaatatatgtttgacagtaagtaggctgacttagtactgaacaattgagtgtatcaatgcatgcccaatataatagtgtgtttcatttcaggataaaaagtgagatgtagttttcggattcaacatatgcattctttttcaaccttgatgtcatcagtcaatgcatagtagtgcatgtacttgactttgtgtatgtaattattattctttggtagttgcaattaaaggatgcattgatacacccaattgtatcatcagttattttgcaattcatattccacccttctgtttttaggaaattctagaaacttttaacttggaagctctagaataccatatcttgctttatatcatggcagttacactgaagctttatgttacatgtgcattcatttttaacgctccaatattgttatccttttatttcctctagagtcgtcacttggaagttcagttgctttgtgatgaatatggcaatgttgctgctcttcacagtcgagattgcagtgttcaaaggcgacaccaaaaggtaaactttagtaaagcatctatataattatgttatttgtaacctttcatgcttacctttatatttcatagacctgaaccatgtctatgaatatatttgtgtgctgttatgagcaggttatttttctccagatcatgtatctttatcctgaactcttgtggacttatcttgaattaacattttgtaaatatttcaagactttcttcatgatgcttatttattacccaacagatcatcgaagaaggtccgatcacggtggcccctcctgagacagtcaaacaacttgagcaggcagcaagaaggcttgctaagtgtgttggttatgttggtgctgctactgttgaatatctctacagtatggaaactggtgactactatttcctagaactgaaccctcgattacaggtttgtctttgcttgttggctgaagattcattgttcatcagaactttgtcttctaagtcttggtccttttcaggttgagcatcctgtaactgagtggatagctgaagtcagcttgcctgcggctcaagtttcagttggtatgggcataccactatggcaaattccaggtatgaacttgtaagggaattttgcataattaatgcaaaaagcttaagagaaaaagatgtaagtttcttgtgatgctaactctagttataattttggtttctttctttcagaaatcagaagattttatggaaaggagcatggtggaggatatgatgcttggaggaagacatcactttctgcaagtccttttgactttgacaaagcagagtctacaaggccaagaggtcattgtgtagctgttcgtgtgacgagtgaagatccagatgatggcttcaagcccaccagtggcaaagtgcaggtaaatgttgttgaatataggatatttaggcttaatattttctgcagggacactgaccaactttactgaactgggacttaaatattttcaggagctaaattttaaaagcaagcctaatgtgtgggcatacttctctgttaaggtatgttgtttaagtttttctgggctggctgcccttctttgggttatttctttgatttctatcaattaatgtacaacaacaaaaaaaatcttttaagagttaatataaacaaatgttggaaacaaatgttctggctaaggagatcaaaatataaacttttgtggaaaaaagttgtgtagtttgcaatatgaatacagtgtgatacttagttgattgtgtcttcatttttgtcctaattaaattatattttgtaattattagactaaatgtgcttatacagacaaatattttgtttgcagtctggtggtggcatccatgaattttctgattctcaatttggtatctccttgacaatgaaagaagttaaattcttttgaatgctgtgaaaaactcttcttaatatttcctattcttctcaggacatgtttttgcatttggggaatctagagccttggcgatagctaacatggttcttggactgaaggagatccaaattcgtggggaaattcgaacaaatgttgattacacaattgatctattaaatgtaagctcttgatcttcttgttacctctaatccaacttattgcaattgcacgtctttgttctcatccgctgcctcacaggcatcagaatacagagacaacaaaatccacactggttggctggatagcagaatagcaatgagggtcagagctgagaggcctccatggtacctttcagttgttggaggagctctttatgtaagaatcgaagcataatgtaatctagttatagttctggtaggttaagttgttatttatatacttgacttattttgtgtcttcagaaagcaacaactagcagtgctgccattgtttccgaatatgttggttatcttggtaaaggtcaaatcccaccaaaggtataatgcatcccagctgtttatgtcgtattttattttcttcgattagttcattaacaaggaaaagcaatgcagcacatttcgctggtcaaaactcttgtgactctgaatattgaagggagcaaatacacggtaaacttcactatttccaaaagttttcattcttaattttctttcaagagacacttcacctaaactccttgctgaatgtttcttagattgaaatggttcgaggtggacctggtagttataaattaaaaatgaatggttcagagattgaagctgaaattcatactctccgtgatggtggacttctgatgcaggtaaactttctaaatcatcatgttccattgtgtattttttttattttaaacaatgactagctagtttcagtggcaaagcaagcattccaatatgctaagcctgttaacagtattgatgctgctgtaaaattgccccgtatggtccatgagagtacaaatggtattaccatagtgatctgattgttcatttgcatttgatctaactttccagaatttccagtcttcttcatactctatttttcttaataagataatgtaccgacaacttgatgatggaagctttgtaagtacctgaaaattttttaggtattggttctgatttcagcactaaggtttataccataaacttcaatactaagtggtcagttaaactttggatctttgcacatcagacttgtcagaactgttttgtttacaatcatccacaattggttatggggtgataattatggatgctttgtgattgttggccatcctgctgctcagaaattatcttgaactttatttgcccccaaatttgaatcatcttttttttgggaattctctttagtttcttttctttctgcaccaatgtttttgttctacatgcccatattgactgcacttgtgcacaactgcacgtctgcacgtctgcacgcatatatcactctaggaatacagttgatattctcaattctcgatcttgtcatatggttaaagtaatttagcagttcagatcttgaacatatttaatttctaaaactctatgaaattcatacagttggatggaaacagccatgtgatatatgctgaagaggaggctgctggtacacgccttcttatcgatggaaggacttgcttgttacaggtagaaacaacttatatatttttcaaaatttttagtttcttgaaggaaattaaatttatttattatctgctagtagaattaatgtaagggaccttttatgatgttttgacattatatattgaaggttctttgatttattaaaaaatgcataagatagatagattgcagtattgcactttgcatctttcaagtgcgcttatgctcaacatgcttaaggtgcttactgcttagattgcccagtgctgctcaaaacttgcatagaactgtgaaaaccattatttcttttgttctatccctaatgtgaaagcttctgtgcgcctgctccggccctactctaatcttcattagcttctttgcactgatttatgtgatattttcttggactgttcatggtccttgctaagagttcctaagtatctgatgtttgtttatgttaatttttgcattccattcctttttagttctaaatgattgtttctatcggtcaaactaaatgctgcaacttagttatcagttgcactcaccctattcaaatgaaatttaaggtacatttcacaaatgggattaacacattaaaaacactttatgtgttaacatgctactattagaaatccagatatgttatttcagaatcataaagcaacgttagatggcttcataaactgtgaataagtggtaaagaattccttcctagatattattgaagaaagtttctcttgaacaagttaccttaaataattaatcataactggttttgtcttcagaatgatcatgatccatcgaaattgattgcggagacaccatgcaaacttcttcgctacttgattgctgatggagagcatcttgatgctgatgcaccatatgcagaggtcgaagtaatgaagatgtgcatgccccttttgttacctgcttctggagttattcattttgtgatgtctgaaggtcaggctatgcaggtaagtaaaccttgtaaagattagaaagaaagtttctcttgtgttttctcataaactacatagaatcttgtttttgcaggctggtgacctcatagcaaggctcgacttagacgatccatctgctgtaagaagagctgaaccattcaatggtacattccctaaagtaggtcctcccactgcagtttctgacagagttcaccagagatgtgctgcaagtttgaatgctgcacgcatgattcttgcaggatatgaacataatattaatgaagtaagggctaacgattaaactttttttttattctttgttatttttaattaattcaaagtgctatctacttttatttctttatactttaagtggcatttctattaactaaaacatatgttttttactaccctttgccaatgttgattagaccaaaatgggtttaaactcttttatgatgcattctaataatctttatttgctgaacctttttagttactttcaaatttatgtagagattaaagcttttattcgaaaacgccaccatacatacacctcatccttggaaaatggaatgtatacaatttgctgattttagttccatcaaatcccagtttagtcacaaggaatcatgctgataagatgctaaatttgtgctaccatgtgcagtgatccatgtctgcagctttgtatatatgccttgtggagattagacgtccatttgtcttatctttttagtttccccaccttcaactttggtgaccgctgcccttaatgtttattttaaggagaagcatcatgcttttgagaaattggttgcttctatcagatgactgaacacctttttatttttatatatcttgttctaatcatgctaagtttcattgaatttctctttatgttttccaattttaaactgatggttatgctatgccaaagtgactaggctctattgtaattttaactgcaaagggactatttgatgattgacactttactttttgttttaattcttttagtttaccattttatatacttgttacttatatgaactgcaacttgcattactgtatacaattttaaaattgtttctttcctttatgcatatactggtttgcatttttttctctaacgtcccaagtataaataggttgttcaagagttactacattgtttggatagtccggagcttccttttctacagtggcaggaaagtatgtctgtattggcaactcgcctgccgaaagaacttaaaaatgaggtttgtgcatagttcttaattttttgtcagaagcacatagtctagtttccagttggacagttggattgtacatttcccaaatttaataattttatgtgcaatttcttatttgatacagttggattctaaatacaaagtatttgaaacaaactcaaacgttcaaaagaatgtggaatttcctgccaagcttctgagtggagttattgaggttagtatgttttagtatgaatatcactcaaataataaggttttaaaactttatttcctcgatctgcagagctatctctcatcttgtagtgagaaagataaggcggcacaggaaaggcttgtggaaccacttctgagccttgcgaagtcatacgaaggtggaagagaaagccatgctcgtgtaattgtgcattctctttttgaagagtacttatctgttgaagagttattcagtgatagcattcaggtgattgtttatccgaagttcattcaaactttttcgactaactcttccatcaaaataaatactaaaggaacaaaactgattctcaatgtttttgaaagtttcgttgctccagctagattttccaaaggccttaaccatgcatttttcttgtataggccgatgtcatagaacgcctacgacttcaataccagaaggatcttctgaaagttgtagacatagtgctgtctcatcaggtatatttgcaacgtctgaagttgttttattttactccatagaattgaccaattctccttaaagtaacatgaatgctgataattcaccttttagtttctctgtggatgagatacatctcgtatgctagtttttccattaacaatatgccgtttttgtttactaaagggtgttagaagtaaaaataagctgatactgaggttgatggaagcattggtctatcctaatcctgctgcctatcgggaacaactgattcgcttctctgctcttaaccataccacttactccgaggtcaataatcttactggatatcttgcacctatcccttcatgtttgtaattcttttgctcacattggcctatccttactcgtgcttggtcaatatggttcctgcagttagcattgaaagccagtcaactccttgaacaaactaaattgagtgagcttcgaacaagcattgccagaagcctttccgagctagaaatgtttacagaagaaggtgaacgtctatctacaccgagaaggaaaagtgctatcaatgagaggatggaggatcttgtaagtgctacgctggccgttgaagatgcacttgtgtctttgtttgatcacactgatccaactgttcagagacgagtgatggaaacatatgtccgaagattgtaccaggtaccaaactgaagtaatatggtaacaaacatgtagctgttaaatatttatctgacactgcttttttctcagccctaccttgtgaaggatagtgtccgaatgcagtggcaccgttctggtttgatcgcgacatgggaattcaccgaagaacatattgagaaaaagaatgattcttctacacaagataagtcatttatggagaaacattgtcaaaagagatggggagctatggttatcgtcaaatctctccagtttcttccagcagcaattagtgcagcattgaaggaaaccagtcatctgtcatctgatactgatcatgatacagtatctaatgggcttcctcaacatgctagtcaaggcaatatgcttcatgttgcattggttggcattaacaatcaaatgagtacacttcaggataggtaacttaattattcttgaatatttccatcatatggtatgtttgtggtaatttgatcatttagttatgaaaggtgcagtcttgtgcttatctttgaatctttttaatggacaaatgttccttgatcatattacagtggagatgaggatcaggctcaggagaggatacacaagcttgccaagattctaaaagataacaaggtagcgactgaactttccaatgctggagtccgagttgttagctgtattatacaaagagatgaaggacgaacacctatgcgtcactccttccattggtctgccgataagcaatgctatgaagaagaacccttgcttcgtcatctggaacctcctctgtctactttccttgaattggttggtgaatgtttttaacttattttattcacatctttattgtaattccctttctctgattaatgccatttgttattgattccattgcaggataagctgaaaggctacaaaaatatacaatacacaccatcacgggatcgccagtggcatatgtacacagttcaagaaactaaaccacttaatcagaggatgtttctgaggacccttgtcagacaaccaaggataaataatggattttcatcaaaccagcttcccgaattagaaactagacatgatttatcctttacatcagtcagcttgttgagatctttgatggcagcattggaagagttagaactacatgtccatagcgaaacaatcagatctgatcattctcacatgtatctctgcatattacaagaacaacaactctccgatcttttacctcgttcagggtaagtcttgttgtctagttagtttggtgtattcttctgaaaaatgtttgtttgtagattaaaaaaaaaatgtagtgtttttggctaaactgatttctcctttgctttggctaaaacattttttggaagtttccatgtttttggaaattattctttaagggctgtttggatacctataatgagggttataatgtggatacttgtagttagtgattttagtgtagttggaaagtaaaacataggtggtaaactacatctcaacatctccaaatttggtgttgttgctatgatgtagtcacatgacgtgccaattttggtgtagttcccaaaattttttttaggtaaaatatatttacaaatatcgcacaagtttattcatctattagtatttcgtgtaaagatatctataaaattaagcaaacaatgaagttgtagttcttttcaactatagctacatgcactatcaactagaactacaagcatccatgtcacaatgttcattaagttaaataatataattttaaaataatttttatttatttattaaaatatagtcatgaggagactttcgaaaataaatttcagaacaaacaaacgcattttttattccaaaatatcatattgttgcttttagataactatttactgagaatgaatttgaacattgtttcaagaaacccttcaaaacaagcaaagtaaatttgtgttctcatcttcgtgctctagatactttgttcatttacttctttcgttagtcattttttgaagttctaactaactcaagcattcaatttgtccagtactcttgatcctgatgcctatcagaatgaaagtcaagtgtccctgcttttaaaagatatggctgtcaggattcatgagatagttggtgtaaggatgcatcgtcttactgttattgagtgggaggtaaagctctggttgggttctgatggtgttgctggtggttcttggagggttgtggtgacaaatgttactggacgtacatgtaatgtccatgtaagtgcgattgattcactttgtctaagactttactactatacttgcatggttagacataatatttcatttccttatgtaggtaacgttttctagcatagctaattgtttgactaggactatattaactaattgtaaaaattgaacttttgccattagagcagttaattaatagatattgctctagcccgtaattttgctttcatttgattgtaaaatactcagtaagtttttgcttcagatttaccgagaattggaggacagcaaatcacatgaagtggtctatcactctgcagcttcagtcacaggacctctccatggtatgccgttgattgctagatatcagccacttagtgttattgataaaaaacgatgggtggcaagaaggagcaacactacttattgctatgactttccactggtatagctcccaattcctgattgatatactcccagttttcttgttttgatacttcaataccttactaattaatatgtgcaggcgtttgagacagcactgaagcagtcatgggcttcttatagtgatactaaagcaccagaaagcaaagctcttctccaagttcaagaacttatgtttgttgacaaaaagggatcatggggtactcctgttgaacctgtatgctgcccacctggtctcagtgatattggcatggttgcttggtcaatggaaatgtacacaccagaatttcccgaaggaaggaagattgttgttgtagccaatgatttgactttcaaagcaggctcctttgggcctcgtgaagatgcatttttccatgctgtaaccaattatgcatgtgataagaggctccctctaatctatttggcagcaaattctggcgccaggattggtgctgctgaagaggtcaagtcttgctttaaggttggatggtctgatgagtcgagtccagaacgtggttttcagtatgtgtatctgacacaggaggactataaccgtattggttcatctgttattgcacatgaactgaagcttgaaagtggtgagatcagatgggtgatcgacacaattgttggcaaagatgatgacttgggtgttgagaacctcactggcagtggtgcaattgccggtgcttattccagggcttataacgaggtatttactcttacatatgtgactggacgtactgtaggaatcggagcctatcttgctcggcttggcatgaggtgtatccagaggctagaccagcctataatcctaacagggttttctacactcaacaagttgcttggccgtgaggtgtacagctcacacatgcaactaggtggcccgaagatcatggctacaaatggtgttgttcatctgacggtatcagatgatcttgagggcgtttctgctattcttaagtggcttagttacgtaccaccctatgtcggtgggccacttccaataataaaatccttggatcccccagaaaggccagtggagtattttcctgaaaattcatgtgatccacgggccgcaatttgcggcattgatgatggcaatggcaagtggttaggtggtatgtttgataaagatagttttacggagacattagaaggttgggcaaagacggtggtcaccggaagagcaaagttgggtggaattccagtaggagttatagctgtcgagacacagactgtgatgcaagtcattcctgcagatcctggtcagcttgattcccatgaacgtgttgtcccacaagctggtcaagtttggttccctgattctgccaccaaaacggcacaagcattattagacttcaatcgtgaagaattgccacttttcatactagccaactggagaggattctcaggcggacagagagatctcttcgaaggtatacttcaggctggttccacaatcgtcgaaaacttaaggacatataagcagcctgtatttacctacatcccaatggccggggagcttcgtggtggtgcatgggttgtggtggacagcaaaatcaacccggatcacatcgagatgtatgccgaaagaacagcaaggggcaacgtacttgagcccgaaggaatgattgagattaagttcagaactaaagaacttctcgagtgcatgggtagacttgatcctgagctaatcagtttgaaaacaaagcttagggagttgaaggcagctggaccttccagagatgtggacgtcctccagaaaagtgtaacggctagagagaagcagttattgcctgtatatacacaaattgctataaagtttgcagagttgcacgatacatccttgcgaatggctgccaaaggtgtgatcaagaaagtggtagactgggagaactcccgttctttcttctacaaaaggttaaacaggagagtttccgaggatgtccttgcaaaaactgttagagatgctgctggggagcagttgtcgtacaagtctgctattgaactgcttaagcagtggttttcatcttccgacaatgtggacgttggaaaatgggaggaagacgatgctttccttgcctggaaagacaaccctaaaaattatgccaagtatcttgaagagctacgagttcagaagatattgcagcagctctcagctcttggtgaatcatcttcggatttgcgagtattgcctcaatgtcttgctacagtccttagcaaggtacagtttctttcattgtgcattcaatttctcttttcaaaatatagacatatagttagatttttacttagttttgcatcattttccctgcaacatggtaaacatttctctataagtattttaatatcactgcaaaatattcaataatgttcctgaacttgttcggagcgccttgattagtagctacactagcattgcgatctcacagtaaaagctatcattctctttgaaataattcttttaactctgggtagatattttttcttctctcaactatatcttgaaaatttgtgcgataaattcctaacatgattattgcttggcattgatgcagatggactcgtctagtagagctgatcttgtcaaagaaatcaaagatatccttggttgatcaatttgaccttatatatggtgcaccgcaacaaattaatgtgatgaacatcccagtaatgccttctcaagacgttgaacgcaagccagtatattatatcttttttttccccgacagagtatctacagctcctaccaatttcaggatatttaatcatatttttccttgcgtagttcatatagaaacgacattacttcagttcacctgtagataagttgaatgttgtcattcaagcaggatgtagcagtccacaacatttgtattttttatatttcgagattcagctgtaaggaataatggctgtattattttctctaggaatgaagagtacactttattgcccaataaaagaaagaaatgtcagggattgtttcaatggaattccaaactgatctcaactacattaggcgtggttaaaaaaaaactacactacgtctgttgccaaatatagaaaagtatttttaggaatatttaggctttgtttgggaaacataatgacttaatacaataattgtgtaaacacaagtaattaattactatatttggataacactttataatacaaagtctctcactacaaatgtaatgtttattatctcataggagcaaaaaaaaaaaaaaactcttaggaggtcgtgtgtaaatgtaatgtttattatctcataggaggtcgtattcattacacagacatataatcccatcataagatatctctcatgtttactaaaaattttcattttaaaatttaaacataaatgttattactaataatatatacattctttatttattatttttattatattacacgtattttagccaatgttgtaagtcactacattacaaattttgtaaatgatttaattacgttgcaaatcattttatccttcccaaataaggcagaatcactttgtcatttcatgtgattaaaaaaataagaggtcagagataattacttggacttgatattatagtaattttgcatgatatcttacccattctatgatatttaaacactcatatttggacgtcatgggatcctatggaataatggaaataactcaatgctcatgaactgggcaaaaacaattagctcttaccttttctttttttcccctaacaagatgattctatgatgtaaataactttactgatttttttttatttgcttaacacactctcaatctatatggtaatgggctaaaatcttttgctcatgagattcaaatatttctcgcgagatttcgttattgccaaacaggtctgttcttttgtagttacttaaataatcataaactttagataagaccaacttaatttaagttaatcaacatcatcaactgaatattaactttactaacacaatgtccgtaatggcatgttttgctcacttgaaataaaaaattaaaaagaatatataagtagcattcgaaaattaatactacgtccaattagagttaacattatgacaacaatacgacaatatccaaattaccatctttgctcctctgtctccaaaaactaatgttattcatctcgctgcccccaaccattgaaccaattgatattctaaccttaatcaatcaattctcccactctcactgacaactggactctgacctcagttggtggcacctccgtcgtgggcttcttcactccttacaactctaataactcctagcttaattttcagtacaaaatcacagtccaaaatgttgtatggatagcaaacaaagttaaacccataatccaagggcagaataacaaactcaagcgaatcggagaagagcaggaccgagcacgagatctggtcgactgagcttgagtgggccaagcttaagcttgcgatggagaagaagtgcgccagagaagaggggcacacctggataaggaaggcgagatacacgagcatgaccaaatcgaaaatgagctggaggggaagggaggaggagaataagggagacatgagaggaggggaaggataacaagagggaga

SEQ ID NO: 64 - DNA, 3209 bp, Commelina diffusa
caagtaattattatataattttcaccctattccattttatttatttttaatttattgactataaaagttacataatactgtactttatttttgtttacttttattgaagaaaaaacagcccttctctcccctcacaaataaattaaaaacaattaatttccaatattagagaaccaaaagtaattccccttaatgacaatttaaaagaaagaaataaatacaaccaacctctaaatcacacacatattcatatatttatacaaataaaataaatagagggagagagtagttggccatcagccccacctaacaaaaacaagtctagagtcaaaattgggacacgaagatgtcatcttcattgtaaaatcaaatgttaattaaaccccaaaaataaaatgtaagcacaagatgtttgaacaagcactttgattcccaattttcacctcaggggatcaaaaaggcaccatcttgacaattatatatacacacactctatacaacattgttgtggtggtagttggcagctgtggctctgaatttcaattcctttgtttgcccttcaattccctgttgctgttgttggtgaggagaaaggaagctggcgtcacgtggtgctgctgtccataccatttaaggccctcgccgtctccccaccccattggtgcccttttccccctttttaaatactgcttttttggtgatttggtgaatggtgtggtgaggagtcgtcaaaatcccgcctttttgctgggattgtgctcgtcttagctcccctgagctgttggttgtgtaaaggtgcgatcttggtgcgttttgttgggtgaattcgagctctttgtcgctgtttagggttcaagattgcgctttttttttttttgcccttgttagtgttggtagttgttagtccaccggctgattgaattgtagctctttggcactgtttgtgtgagtgatctgctttgcatcaggggactacaaatttcattttagtagtgttatgctggaattttggttctgctgattgggttattgcgcctgtgttattttgtcttgtgcgtcttaaattctgtctgtagtttagtgttgtaacgagtgcttctcgcttctagactttgtttgtatcttctgtgtcttgattattgttactattattattttattttatttttggttagtgagtcaacctatggggttagtaataagacattgtttcagttagttatgtgaattggtaactcttaatctcgtttagaagattggtgagttagtttttacctggttctgtacattcgaatagcttttactgttgatttgctgcatttttaccaaattctttgtcgcttttttggtgtaaagcaagaatgagaaaaatgatacttgattgaattatgggttcccaaaccaagtaataatttgggaattgctttctgataactctttattggtggagctttggtactaggatatatatgtatatatatgattatatcatatggatagcaactgggtagttgttcagttagaatcttggtcgttaaaagaaaaaagaatgaattgaatattcatttatttgagcctatgaggataatttgttaactgaaaatggttttgttcgagtggtagggatgtctaaggagccatgtagttcgtttagtttgttattctattttcattcttataaagaaatttaatttatcatgaaagcattgggaccagttgtataaatagttctcctttttactgcaaatggcagttacataaagaatctattacaagaatatgcttattaggagctggtttatattttcagtttgcactttttctgtgtttactaaagaaacaagttattcttgtgcctttcttacctgacgtcagagaatgatattttcttgaaagtcaaatgttgcttattatatatcccgtcactttgcgtgtatattgatgacactgattaaatatctatgtagaacgcctgaagcccagaagggagcagttatggcagatgtctggcaagatcatgggattttaaatgggacagttcaagtcaaacatgcagctacaacgtctgaagttgatgatttctgttatgcacttggtggaaagagacctattcgcagcatattgattgctaataatggaatggctgctgtcaaattcatgcgtagtattagaacctgggcttacgaaacatttggatcagaaaaggcaattttgttggttgcgatggcaactccagaagacttgaggataaatgccgagcacattagaattgctgatcaatttgtagaggttcccggtggaaccaataataacaattatgcaaatgttcaactcattgtggaggtcagttttgcttactttttggctgacattactttgattgagcattttgattgtttcttttcttgtttgtgctgattttgacaacacactttgtgacagctggccgaaataacacgtgtttctgcagtttggcctggatggggccatgcatccgagaatcccgaacttccagatgccctgaatgcaaagggaataatctttctcgggcctccagctgcgccaatgtcagcactaggtgataaaattggttcttctctaattgctcaggcagcaggtgtaccaactcttccgtggagtggctcacatgtaatcttacttgctaatttgcaaatacattatttcatatttctcattctttcaccaaaatttacatgtgaaattatcttttaggtcaaaatttcagcggaaagttgtatggacacaatacccgaagagatatacaagcaggcttgtgtttatacaacagaagaagcagtggccagctgccaggtagttggctatcctgccatgataaaggcatcttggggcggtggtggtaaaggaataagaaaggtatagcataaaaataatcagtagtagttcttttattctctccaacaatgcttacagaaagggtggcaaatagattagtgcaatgcctgtggctatatatgccaaagaaggtagagaaacgctgaaacggatattgtttcttaatatttttgaggttatgatcttattttggtgttcagtcaactcctgaagtccaacaaataatgatgtagccatatgtattatctaaacatgattcatttgtttattcatggttgtcattacaaatggaattacagtactcgttatgatatgcaaattaaaaaaaaaaaaaa

SEQ ID NO: 65 - DNA, 1629 bp, Digitaria sanguinalis
gttgttgcaaaatgaatgtgacatttaaagctgggtcctttggtccaagagaagatgcgttttttgatgctgttaccaatcttgcttgtgagaggaaacttcctcttatctacctggctgcaactgctggtgccagacttggtgtagcagaggaaataaaggcatgcttccatgtcggctggtctgatgatgagagccctgaacgtggttttcactacatctacctaactgaacaagactattcacgtctaagctcttcagttatagctcacgagctgaaactagaaaatggagaaaccagatgggtggttgataccattgttgggaaagaggatggacttggttgtgagaatctacatggaagtggtgcgattgccagcgcgtattctaaggcatacaaagagaccttcaccctgacatttgtgactggaagagctgttggcattggagcttacctggctcgtttaggtatgaggtgcatacaacgtcttgatcaaccaattattttgactgggttttctgcattgaacaagcttctgggacgggaggtatacagttctcatatgcaattgggtggccccaaaatcatggctacaaatggtgttgtccaccagaccgtgtcagatgatcttgaaggtgtttctgctatcctgaaatggctcagttacgttcctccctatgttggtggtcctcttcctattatgaaacccttggacccaccagaaagacctgtaacatacttccctgagaatgcatgtgatgctcatgccgctatatgcggcattcaggacggtgaaggcaagtggttgggtggtatgtttgacaaggaaagcttcgtggaaacattggaaggctgggcaaaaactgttatcaccgggagagcaaaacttggtggaataccagttggtgtcatagctgtggaaacccagacagtgatgcaagtcatccctgctgatccagggcagcttgattccgctgagcgtgtagtccctcaagcaggacaagtgtggttccctgattctgccaccaaaacggctcaggcattgatggatttcaaccgtgaggagcttccacttttcatccttgcaaattggagaggtttctctggtggacaaagggatttgtttgaagggatacttcaggctggttcaacaattgttgagaatctgaggacatacaagcagcctgctttcgtatatatcccaatgggtggagagctgcggggaggagcctgggttgtggtggacagcaagatcaatccggaccacattgagatgtatgcggagaggactgcgaaaggcaatgtccttgagccagaaggattggtggagatcaaattcaggccaaaggaactggaagattgcatgctaaggcttgatccagaattgattggcctgaatgctaggctgaaagagttgaagaagcaaaatgccagcaactcggaaacggagaccatccgtaagagtatgacagttcggatgaagcagctaatgcctatatatactcaggttgccacacggtttgctgagttgcatgacacctccgctagaatggctgcaaaaggcgtaattggtaaggttgttgattgggaggagtctcgggccttctctacaggagattgcgaaggag

SEQ ID NO: 66 - DNA, 1468 bp, Digitaria sanguinalis
cgtggtgtagatgacagccaagggaaatggttgggtggtatgtttgacaaggacagctttgtggagacatttgagggatgggcaaaaacagtggttactggcagagcaaagcttggaggaattcctgtcggtgtcatagctgtggagacacaaaccatgatgcagcttgtccctgctgatccaggccagcttgattcccatgagcgatctgttcctcgggctggacaagtgtggttcccagattctgcaaccaagacagctcaggcattgttggatttcaaccgtgaaggattgcctctcttcatccttgccaactggagaggtttctccggtggacaaagagatctgtttgaaggaattcttcaagctgggtcaacaattgttgagaatcttaggacatacaatcagcctgcatttgtctacattcctatggctggagagctacgtggaggagcatgggttgtggttgatagcaaaataaatccagaccgcattgagtgttatgctgagaggactgcaaaaggcaatgtccttgaacctcaagggttaattgaaatcaagttcagatcagaggaactccaagactgtatgggtaggcttgacccagagttgataaatctgaaagcaaaactccaaggtgcaaagcttggaaatggaagtctaccggacatagaatcccttcagaagagtatagaagctcgtacgaaacagttgttgcctttatatacacagattgcaatacgttttgctgaattgcatgatacttccctcagaatggcagctaaaggtgtgattaagaaagttgtagattgggaagaatcacgttctttcttctacaaaaggctacggaggaggatctccgaagatgttcttgcaaaagaagtaagaagaatagctggtgaccacttcactcaccaatcagcagttgagctgatcaaggaatggtacatggctgctcaaccaacaacaggaagcactgaatgggatgacgatgatgcttttgttgcctggaaggagaatcctgaaaattataagggatatatccaggagctaagggcccaaaaggtgtcccagtcgctctccgatctcgcaaactccacttcagatctagaagcattctctcagggtctttctgcactattagataagatggaaccctcccagagagccaattttgttcaggaagtcaagaaggtccttggttaattggatcataccaacacaatgtgtatgcaacatgttttttgttgaagtacatacatagaaggcccttgatgagatctgatctgaatctaccattatttgttaaaatttgtttggttggacgatcatgtggttgagtaagtgctaagttgtctctgtagttctgggatgtattaccagcagttcgattgtgtaattttagagtgtatcatgcggatattacattcagttgagtggttcattaaattttgaactcgaataattt

SEQ ID NO: 67 - DNA, 1194 bp, Digitaria sanguinalis
gcaagcgaacttcttgaacaaactaaactaagtgaactccgtgcaagcatcgcaagaagcctttctgatctggggatgcataagggagaaatgactattaaggatagcatggaagagttagtctctgccccattgcctgttgaagatgcacttatttccttgtttgattacagtgatccaactgttcagcggaaagtggttgaaacatacatatctcgattatatcagcctcttcttgtgaaggatagcatccaaatgaaacttaaggaatctggtgccgttgctttttgggaattttctgatgagcatgctgacactaaaaatggacaagaagctgttcttggtcaaaagagatggggggccatggttgtcatcaaatcacttgaatctgcgcgaacagccattgtagatgcattaaaggattcggcatggcaatccagctctgagggcaacatgatgcacattgcattattgagttctgaaaatgaaaataatatcagcagtgatgatcaagctcaacataggatggaaaaaattaccaagatattcaaggatagtggtgttgtaaacgatctccgatctgctggtttgaaggttataagttgcattgttcaaagagatgaagtacgcatgccaatgcgccacacattcctctggtcagatgaaaagagttgttatgaggaagaacagattctccgccatgtggagcctcccctctctgcgcttcttgaattggacaagttgaaagtgaaaggatacaatgaaatgaagtatactccatcacgcgaccgtcaatggcatatctacacactaaggaatactgaaaaccccaaaatgttgcatagggtatttttccgaactattgtcaggcaactgaatgcagacaacaaatttgcatcagcccaagttagcaacactgaagttggaggtctggaggaatctttgtcatctacatcaaatagcattttaagatcgttgattactgctattgaagaattagagcttcatgcgattaggacaggtcattctcacatgtatttatgcatattgaaagaacaaaagcttcttgatctcatccccttttcagggagcacaattgtcgatgttggccaagatgaagcaactgcttgttcacttctaaaatcaatggctctgaagatacatgaacttgttggtgcacagatgcatcatctt

SEQ ID NO: 68 - DNA, 586 bp, Digitaria sanguinalis
gagaagaaaaggggtatcatggttgtaatcaagtctctccagtttctagcaactgcaattgatgctgcactgaaggagacctcgcaatatagagcaggtgctgtaagtgtctcgaatggtaaccatgtaaattcaaatcaaagcaatatgctgcatattgctttggttggtatcagtaatcagatgagtacactccaagacagtggtgacgaggatcaagcacaggaaaggatcaacaaactttccaaaattttgaaggataatactattacatcgcagcttaatggtgctggtgttaaggtcgtcagctgcattatccaaagagatgaagggcgtccaccaatgcgacactccttccattggtctgctgacaagctttattatgaggaggatccaatgctccgccacgtggaaccaccattgtctacattccttgagctggacaaagtaaatttggagggttacactgaagtaaaatacaccccatcacgtgatcgtcagtggcatatttacacacttatcaagaacaagaaagatcagagattaaacgaccagaggatgttccttcgtaccatagtcagacaac

SEQ ID NO: 69 - DNA, 488 bp, Digitaria sanguinalis
cagcctttgaaattactggatcagaaacgtcttttggcccgtaaaagcaatactacttactgctatgactttgcactggcatttgaagcagcccttgagaatatctggtcatcgaaactcccaggtgttaacaggcctggtgctaagcttgtaaatgtgacagagcttgcgtttgctgacccaagaggctcatggggtacaccacttgtggaaataaaccgtgagccgggccagaacaatgtgggcatggtggcatggaccatggacctctgcacacccgagtttcctcatggaaggacaattttggtagttgcaaacgatgtcacgtttaaaaacgggtctttcggcccgattgaagacgcgtttttcgaggcggttaccgaacttgcttgttccaagaaactgccactcatctatctggcagctaactcaggggcccgaattggggcggctgaggaggtcagatcttgctttagaatcgggtggtc

SEQ ID NO: 70 - DNA, 10084 bp, Digitaria sanguinalis
ttttcaggtttgtttgtttcgattttccgattgtgttttttgagtcgctgttgcttgatttctgctgctgttactgctggttgactcttctagtgtgttgattgagatttgttagtttgattcgacttcgattttggaatcggatttttgaacttggagttgtaagtgttttgaagcgtgtttttcggcgttttagttgcgtttttcttatggatccgattcttttatatgaatgcggcgtttggcgctgagcaacatgaattggaataaacttgtggtattttgctctttttctatatattagtctaattcaacttcgattatggaatctgatttttgaatttggagtatatgtagtatatttaaacatgtttttcggtgttatcattgtgtattttttatggatcctgtgcatcggagatgcgtttatatgaatactgtgtttggtgctgagcaacataaattggattatacttgtcgaaaataattctcgtaataaggttcaaggtatctagaagtctacctgaagtgatatagtggaccatgcggatttgattctttgagttgtttttcttcaagtcaaagatcctgttatatttaattatttcttttgatttatgaaatgagtaattaagcaagtggtatgctcaattcgttgaaaatattatgtattgaaaaggatttgaaggttacgaactggattttcaactcgaatgagtttttttttgtgcagaatgttggagacacagaggaggcagccgttagcagtaggggttactcgtgggaatgatttcaccaatggtgtgcttacgatgagaagccctgctacaatatcagaagtagatcaattttgccgtgctcttggaggaaagagaccgatccacagtatattaattgcaaacaatggaatggcagctgtcaagtttatacgaagtgttaggacatgggcttatgaaacttttggcactgaaaaggctatcttgttggtggccatggcaactccagaagacatgaggatcaatgcagagcatattagaatagctgatcagtttgtggaagttcctggggggacaaacaataacaattatgccaatgtgcaactcattgttgaggtgtgtaagttcataaccttttagcatattggatagcttatgttgtgttagtctaaagttcgataattctaagcatataatgatattaaatgtgtttaaggatttctcagtaataggaatttgtaaatcttttctgtcaatgggttttacagaaattcataaattataatgtaatctagaagctttgaaattgtatttttgcacatctcagaagattatgaagtaataggctggtatacagtgaatttcattattgcaagatattgttgttatgtgctcactcaagagcattcttttcaatttggcaatgtgaaaaggttcagttagaaatatcacttgttacccttgttgtttgcataactaagtttgattttgtgtccagatggcagaggtcacccatgttgatgcagtttggcctggttggggacatgcatctgaaaacccagagcttccagatgcactaactgcaaagggaatcgtatttcttgggcccccagctgcgtccatgggagctttgggtgataaaattggatcctctttgattgcgcaagcagcagatgttcctactcttccatggagtggctctcatgtaagtaatgctcttctcaagctgttctttcattttctgtagtcattccaatctaagatatcatgatcttccttataggtgaaaattcctccagaaagttgtttgattaccatccccgatgacatatatagagaagcatgtgttcacacaacagaggaagctattgcaagctgccaagttgttggttaccctgctatgataaaggcatcatggggcggtggtggtaaaggcataagaaaggtttggcttcgatataacaaatttccgagtgtagtgttcaagtctgtagtgtacgatggctgagttttgttttcttggattatctaggttcataatgatgatgaagttagggcattgttcaagcaagtccagggtgaagttcccggttcacccatatttataatgaaggtcgcttcacaggttaggatattatctagcttctaatttgatacaagagattttactttgtgattcttgacgcgtgaatcgaattctgatgatctatttgattttccttatgtagagtcgacatttagaagtccaattgctctgcgatcaatatggaaatgtagcagctttgcatagccgtgattgtagtgttcaaaggcggcatcaaaaggcatgtttatttctctcaagtaattttgattttgtctgcttagtgaaattgaccatgaaagtataagcttagtgtgaagagcctgaggctctgaccacatgcatgttgagaatgagccagtgacttttaatcagtggctcaaccattaatttctccccttccaaatttcaactgtttgtacatctatctagtatctactacatgggttatgcatttcaaaaaaggcctaacttgtgttgagatgtgaaacagataattgaggagggtccaattaccgttgcaccattggtgactgtaaaaaaactagagcaggcagctcgaaggttagcgaaatctgtgaattatgtgggcgctgctactgttgagtatttgtacagtatggaaactggcgagtactattttctagagctcaaccctcggttacaggtataaatgaatatagtttgtagggatgtgaagttgttatgctctatagtagtaatgatatctaaaatgcttaaattttatgttgctcaattgatgacaattggataaaccgtattcacttgggaaaaaccatcctgaatatagttcgtacctcattcaccttgcgtactactgatattgatcctatgaatctgttttttaaaatatctttgtttctgtaataaattgttctttgacttttctaatgatctttaatctacatcctaatctggatgtaggtggagcatcctgtcacagagtggattgctgaaataaatttgcctgctgcccaagtagctgttgggatgggaattcctctgtggcaaattcctggtatgaccgcaaaagttggaaattcgcattctcttgctcattagacatgtttctttgacattctgttcatttttattcagagattaggcgattttatggaatggaacatggtggaggatatgatgcttggaggaaaacttcagtggctgctacgccttttgattttgacaaggtagactctacaaagccaaaaggtcattgtgtagctgtacgtgtgacaagtgaggatccagatgacggtttcaagcctactagtggaaaagtactggtaaggttttcaggttgactattctaatttgaatttccttctattccaaaattccttatcctgtaatgaacttgtacttttattgtcttgcacaggagctgagttttaaaagcaagccaaatgtgtgggcttatttctctgtgaaggtgactttttgctgctctctttctttggaacatgtttatgttgacacaattggtttctgacttaataacttcattctgatttgtagtctggtggaggcattcatgaattctcagattcacaatttggtaagtaataattgctaaataatcacacttcatggataataatgaaaagaagtttgtgagatgagttatccaatctgctgcaaattaatggttcttttttatcttcttgtgacattttttttaacaaaagctacagtctgcttttcagtttagtcttttccgtttgttacatttgctatcgaaagcactcatgattgtcgtaatctttccttaggacatgtttttgcatttggggagtccagagctttggcaatagctaatatggttcttgggctgaaggaaatacagataagaggagaaatccgcaccaatgttgactactctgttgaccttttacatgtaaactatcttagctgttgatgttccctttatacatcatgtaaactttcacgaggaacatgaacacgagttgacatgctatgcaggcttcagattatagggaaaataaaattcacacaggttggttggacagtagaatagctatgagggttagagcagaaagacctccttggtacctctctgttgttggaggggcactatatgtaagttgtcacgatttcacatgagaggatgactgtatacttttggaatgctttattatgtctttcagaacttgccacttaagtgttcaattttttgtttgcaccagaaagcatctgctagcagcgcagctatggtttctgattatgttggttaccttgaaaagggccaaatccctcccaaggtacatcaaaagtatatttgtacaattgtatatgtttcttattcagccgattatgttgatgttgatgttgatgttagttgatcttgttttcagcacatatcacttgtgaactctcaagtttcattgaacatcgaaggaagcaaatatacggtatggtacctttcatattagtatcttaaatgaataaattttagtttggtgatggatgccatttacgtttgtaaaatcattgctagattgacatggttagaggggggccagggagctatagattgaggatgaatggatcggagatagaggcagaaattcatacactgcgtgatggaggtttattgatgcaggcaagttgactcattaaccatggctgttgtaaactaataattttcgtcctttttatcatttaatatttgctttagtcgaccctccatgctttggagaccataacagactctattctgtttcttcacagttagacggaaacagtcatgtaatatatgctgaagaagaagcagccggaactcgccttctaattgacgggaggacttgcttgctacagaatgatcatgatccgtcaaagttagtggcagagacaccatgcaaacttctgagatatttggtttcagatggtagtcatattgaagctgatgctccatatgcagaggttgaagttatgaagatgtgcatgcctcttctttcacctgcttctggagttgtccattttaaaatgtctgaaggtcaagcaatgcaggtgtgtttgatttcacaaacacgtgcttttgggcttgataagtactttttagttttatatgaatagtcagttttgatgtgaatctaagaagttttcatgtaggctggggagctcattgcaaggcttgatcttgatgatccttctgctgtaagaaaggcagagccttttcatgggagattcccgctacttggctctccgactgctatttctggtaaagttcatcagagatgtgctgcaagtttgaatgcagcccgtatgattcttgctggctatgatcataatattgatgaagtaagttgcaagctggctagtttcaacatgaacttaattgatgaattaattgttcattctatattttgttgattgtgtaatttcataacaaaataatgaactatgcatttggtttattatactgacaattatttgttgaaatctgatgtaatatctcaatgacatctataggtagtgcaaaacttgctcaattgccttgacagtcctgaactccctttccttcagtggcaagagtgcttgtctgttctagcaactcgccttcccaaggatcttagaagcgaggtgaataatttttctgtaattttttcatgaccacatagtcttcttgctcacaatttgatattggcaatttgtatagttggaatcaaaatacacagagtttgaaggaatttcaagctcccagaacattgacttccctgccaaactgttaaggggtgtcctcgaggtgggttccttattgcatggctctcttggaatttctcattatctgttttttttgctgtttaatgagatgtgtatgcttttcctccaggcacacctgaaatcctgtcctgagaaagaaaaaggagccctggaaaggcttgttgaacctttgatgagtcttgtaaagtcttatgagggaggacgtgagagtcatgctcgagtgatcgtccaatcactttttgaagagtatttatctgtagaagaattatttagtgacaacatccaggttagcttcttcctatcaaacataatatggaattattttggattctgaaagtcttccctctttggcatcttttagaaaattaagcataatactaggtactatatccattattctttataatcatgaaatttaatttttacagaagaaaagtggaatttctatatatatttaaaccaagctggcaagctttgaattcaatcctgttgtttattgttttatccaacatgccaaaaatattaggaacttcatgtgactacttgtatcattcttattctgtaattacagtaaagtaacttgtcatatcctaatgttataactcgtaacattcttctttaggctgatgtgattgaacgtctcagacttcaatataagaaagaccttttgaagatagtggacattgtcctttctcatcaggtatctgattttcggttttaatttttatctcgggttttctaaaatagaattctgagtttgtggaaataactaccgtatttgttggtttatagggtgttaagagtaaaaataagctgatactacggctcatggaacaacttgtttaccccaaccctgctgcatatagggataaactcattcggttctctcagcttaaccacaccagctattccgaggttggcagctatacttggtccatctgtaatttcataaagttgttgctctgtttccttttgttcacaagttcatttttgagagttttccataggatggtgactgacaggaagaggattctaatgttttctcttggaggattttttctgtattttcatttcttgtcggtcattgattaattccgtttctggtatcagtatcatcaaaatgttgtctttttctgtatactgatgctgaattatgtgaacagttggcattgaaggcaagtcaactcctagaacaaaccaaactgagtgaactccgttccactattgctagaagcctttcggaattggagatgtttaccgaggatggtgaaaatatggatactcccaaaaggaaaagtgccattaatgaacgtatggaggatcttgtgagtgctcctttggctgttgaagatgctttagtgggtcttttcgagcacagtgatcacacccttcaaaggcgagtggtggaaacttatgttcgtaggctatatcaggtactgtgttgtagaaacttaaaacttttatctggtgatcaaacactagacgaaacttgatcttgatcaactgtttgtctaccgcaccagccctatctggtcaaaggtagtgtcaggatgcagtggcatagatttggtcttattgctacatgggaattcttgggagagcatatcgggagaaagaatggatctgaaggtcaaatgtcagatgaaccagaggctaaaaaacagtctaataagagatggggagcaatggttatcatcagatctctgcagtttttgccttcagttattggtgctgcattaagggaaacaaatcaaagccttaatgagtccattccaagtggattagtaaaatcagcgagctttggtaatatgatgcacatagcattggtaggcatcaataatcagatgagcttactacaggataggtaacttccttcggtactataatataagcgtttattttaatcataaaaattagtagcattttacattctattattcattgtaagatctcaagtcttcttaatcatttctgcatttgaaaccttgatagatctggatagattccttatttttgtttaaaatttatgatagagttacctggtctcgaacccttaaaacatgcacatatattggcttgccaaacataagttattttgcgttgtcaatttcgattattgacggtcagcttgttaatgctcctaactggcaccatctatgacattttgcagtggtgatgaggatcaggcacaagagagaattaacaagttagccaaaattctcaaagaacaggaactaggttccagtttgagcttgtcaggcgttggagttattagctgtatcatacagagggatgaagggagagcccctatgaggcactcctttcactggtcagaggaaaagctttattatgaggaagaacctctattgcgacatttggaacctccactatccatctaccttgaactggtttgtcacctatcgcagtgtttcaatacatttttttggcagaaacctttattgagcccctgaacttaccagttttattctcaagttattatttgactacattaaatacttaattactattgattccacattatgaccttgcaatataattacaagtgttacgttttattgataaaattataactgttgctattttgttttacatatatcaaggactgcactatagtaaaaaaatgaggactcgataggattggaaagttcaggggcttactaattgtttgagcggaaaaaaatatatataaatgtgaaattggataattctatatcattcatctgaagcttattatggcctttttttgatccaggacaaacttaaaggctatgacaatagacaatatactcagtcaagggacagacaatggcacatgtacactgttgtagacaaaccagttccaatccagaggatgtttctaagaacccttgtgagacagcccacaagtacttcatatcaaggtcttggcgccgaagcacccaatgtgcagtgggccatgtcctttacgtcaaagagcattttgaggtccttagtagctgcaatggaggaactggagcttcacgtgcacactgtcaaatctgaccatgctcatatgtacctctgcatattgagggagcaacggatagaagatcttgttccatacacgaagtaattatatcaatctttatgatttattgtgtacttggcaccataactttatgtgtactcactatgagactccatctccaggaaaaccgatgtagatgccaaccaagaagaagctgcggtagcaagaatcttggaagaactagcgaggaagatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatgtaagtatctgcgcatcttatttcaagaaaatgtctttcccttccatgcattccttattagtcgacttagtaatggggaatgtcgagaagtgttggatggttaccaatgtgagtaccatcactgtttagattaaaattgaccattgctttagcaatacaataatgaatctaattgtggcatgggaggcttttctatgtgtgatccatggaaaaacttgtatatagttccttagtaggtttgagttgttttcatttttcttttatcacattgtaattgtattggtgattgatacgaaaattagatatatcgggaacttggggacgagagcaaacatgaagtggtgtaccattcaatctctccaagaggcccactgcatagcatgccagtgaatgctgtttatcagcccttgggagttctcgatcgaaaacgtttgttggcaaggaagagcaacaccacttactgctatgattttccactggttagtatttctataatcattaatcaaacatcagtttttttattggggataattaaaatcaaataatttttcctggcctcatccttttcaggcgttcgagacagccatcgaacaattatgggaatctcaatcaccagggactgaaagaaacaaagaaaaagtcctaaaagtctcggagcttgtttttgccgatcagaaaggtacctggggaactccacttgttcatgcagaacggccagctgggcttaacgacgtgggcatggtagcatggtgcatggaaatgttcaccccggaatgcccttccggaaggaaaatcttgatagtagcgaacgacgtgaccttcaaagccgggtctttc

SEQ ID NO: 71 - DNA, 2626 bp, Digitaria sanguinalis
aatcaactttatgctcaagcgaaagagcttatatttgctgattcagttggagcatggggcactccagtggttttagttgaacgccctccaggcaacaatgatattggcattgttgcttggaacatgaagctgtccacaccagaatttcctaatggccgcgatattatagttgttgcaaatgatgtgacatttaaagctgggtcctttggtccaagagaagatgcgttttttgatgctgttaccaatcttgcttgtgagaggaaacttcctcttatctacctagctgcaactgctggtgccaggcttggtgtagcagaggaaataaaggcatgcttccatgtcggctggtctgatgatgagagccctgaacgtggttttcactacatctacctaactgaacaagactattcacgtctaagctcttcagttatagctcacgagctgaaactagaaaatggagaaaccagatgggtggttgataccattgttgggaaagaggatgggcttggttgtgagaatctacatggaagtggtgcaattgccagtgcgtattctaaggcatataaagagaccttcaccctgacatttgtgactggaagagctgttggcattggggcttacctggctcgtttaggtatgaggtgcatacaacgtcttgatcaaccaattattttgactgggttttctgcattgaacaagcttctaggacgggaggtatacagttctcatatgcaattgggtggccccaaaatcatggctacaaatggtgttgtccaccagaccgtgtcagatgatcttgaaggtatttctgctatcctaaaatggctcagctatgttcctccctatgttggtggtcctcttcctattatgaaacccctggacccaccagaaagacctgtaacatacttccctgagaatgcttgtgatgctcgtgccgccatatgtggtgttcaggacggtgaaggcaagtggttgggtggtatgtttgacaaggaaagcttcgtggaaacattggaaggctgggcaaaaactgttatcaccgggagagcaaaacttggtggaataccagttggtgtcatagctgtggaaacccagacagtgatgcaagtcatccctgctgatccagggcagcttgattccgctgagcgtgtagtccctcaagcaggacaggtgtggttccctgattctgccaccaaaacggctcaggcattgctggatttcaaccgtgaggagcttccacttttcatccttgcaaattggagaggtttctctggtgggcaaagggatttgtttgaagggatacttcaggctggttcaacaattgttgagaatctgaggacatacaagcagcctgctttcgtatatatcccaatgggtggagagctgcggggaggggcctgggttgtggtggacagcaagatcaatccggaccacattgagatgtatgccgagaggactgcgaaaggcaatgtccttgagccagaaggattggtggagatcaaattcaggccaaaggaactggaagattgcatgaatcgactcgacccaaagctgatatctttaaaaaccaaactaaccgaagcgaagaatagtgggacctacgggatggtcgattccgtacaacagctgataaaatcccgggaaaagcaacttctgccgctttacacgcaaatcgccacacgattcgccgagcttcacgactcggctttacgaatggcggcaaagggggtgattcgagaagttgtcgactgggggatttcacgatcttacttctacaaaaggttaagaaggagaatcgccgaggcttcgttggtgaacaccgtgaaagatgcagcgggtgataagctccagcataagtcggctatggagttggtcaaaaactggtttctggactcgaaaggcgattgggaaaacgatgaagctttctatgcttggaaggataatcccgcgaattacgaggaaaagctacaggagttacgggtccagaaggtgttgcttcagttaactaacattggcgagtctttgtcggatttgaaagctttacctcaaggtcttgctgcccttctaaataaggtaattttttgggttttttcttccaggaatattgtttatttagacgatcgagtcggatgttatgtaatactttatgtttgatgtaggtggagccatcgagccgaggggcgttgatcgatgagcttcggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtgaatagggggaattagttcatatgattattgttgttataaacaaatcagagatagagagagctatatttattattatatttgcgaattaaagttattaggagtagtataatttggcggttgttgcattttacgtgtaatgatctgaatgttgtttgttcgtgattattgaataaaagggcatcaaatgccataatttatctttctttgttaacaagattttaattagttttttttaattattagtatgttttgtataatttatatt

SEQ ID NO: 72 - DNA, 2351 bp, Digitaria sanguinalis
tctctctctctctctctcggctatgttcttcgcttgcttctcagctctgcaccgctcgggcgatcgaatttcgcattgctccgtgtgccgccggccgctcgaggctgtccgcgtccaaatccaactccaaaacgcgacttcgcgcggcgccgacgctactaaatcgccgcttgtacttctcagccgcgccgggcaacttgcttcggcgttccgtcgagcaggttgtgcgcgcgccaagtgtgattggggaaatagagatcctgcctgctgctggcaaccggaatttcgtcaatcaaaggcagggggtttccttttcagtttggttagggagcttgttgttttgtttgttggggtgccggggttggtcccctctgttttggattggattgtagtggcctttcgggtttccactttggactcgcctctagtgcggacctttctgtgatcgcataacacatactacggtcaatatattagtcacctttgcctaggtataatcaaaacctgtgtcctgacacttcttattctgctggctgcttgtactctaattcaatacaatcagctgctgcctatggatgaatctggttaaatagccacttctctgttatcaactctatatcatctcagcacactatttcatatactactagttgcctgtccgaaagtatcgtgcttgcgatttgtttcttttgcctgttcgatagtcatgcagtttccccgtcacaattgatgtactaacaatctgtttcttttgcactgaccaggaagtttgaacttcagagggtgagataatggttgagcctgaccagatgaacggcatactgaatgggatgcctaatttgaggcacccgtcctctccatcaaaggtcgatgaattctgtaaagcacttggtggcgactcgccaatacacagtgtgctagttgccaacaatgggatggccgcggtcaagttcatgcgcagcatccgcacatgggccttggagacctttgggacagagaaggccattctcttggttgctatggccactccggaggacttgaggataaacgccgagcacataagaattgctgaccaattcatagaagttcctggaggaacaaataataacaactatgcgaatgtacagctcattgtcgaggttagcacaactcatcatcctggaagtgactaacttgtgtttagtttacatatgttttcactctggacaattcagtaattaacactgaattcacatttcacagatagcagagagaactcgtgtctctgcagtttggcctggctggggtcatgcatctgagaatccagagcttccggatgctctaaacgaaaaaggaataattttccttgggccaccatcagctgcaatgtctgcactcggtgataagattggttcttctcttattgcacaagcagcaggagttccaactcttccatggagtggatcacatgtatgccttcgcctatttctgtgtgcctttgcttctaacttttatctgctagtttaatattcacttaacattgaaccaaactcactgcaggtgaaagttccaccagaaagctgccactcgattcctgaggagatatataaggatgcttgtgtttccactacagaggaagcagtggctagttgccaggtggtcgggtatcctgccatgatcaaggcatcatggggtggcggtggtaaaggaataaggaaggttggttttctttttctatttgaatctgagaaaaaagaagggaaatgtccagtattcagaaaacatgatctgaaagtttcaaggaaaaagttagagtaaattaacactaattttgatatcatttgcatggattcataggtacacaatgatgatgaggtgagggcactgttcaagcaagttcaaggagaagtccctggctcacctatttttattatgaaagtggcatctcaggtgagaactgattcaacaaattttggctatttaatggtttgctttggcgcccacctttgttctttgtatcctgagctcttctatgtggttgcatttgtttctgaaagcttttgtttgttctttctttgtagagccgacatctggaggttcagttgctctgtgacaaacatggcaatgtggctgcactgcacagtcgagattgtagtgttcaaagaaggcaccaaaaggttagctcgtagaattttttctaagctttgatttacattgtgatttcttgtaatttgtcccatacttggattgtgtagtgtgctgtatagtagttttatatatttcttgaataaagtttaggtgacctagtgcaagacgaaaaaaaatccatattgcatttttgtgaagaaaattttctcacatttacctctgca

SEQ ID NO: 73 - DNA, 2088 bp, Digitaria sanguinalis
ttcagttggatggaaatagccatgtaatttatgcggaagaagaagctggtggtacacgacttcagattgatggaaagacatgcttgttacaggtgcatatgctcttttccctttattatcttcttggtgtctgattgggagtcttctgccagatttgccttttccgtttattacaacaatttgtctgtcatccttaacttcagaaaatcctattgtttgctttcttagcatacttgatttcagtgaaatttgactacaatacctgaattaaaaaaaaactgtaatcgtgtgattaaaaatcaagaagtagcctttttaggattgtaatattttggtattgctacactatgccagaagtaggtcacaagtgtgtgttcttgcagaatgattatgatccatcaaagttagtagctgagacaccctgcaagcttcttcggttcttagttgctgatggtgctcatgttgatgccgatgtaccatatgcggaagttgaggttatgaagatgtgcatgcctctcttgtcccctgcttctggtgtcatacatgttatgatgtctgagggccaggcattgcaggttatttttgtacatccctccttgcattgtgcttgcatcacataactgcatgtaacatttttagacttatattttgttctaggctggtgatcttatagcgaggctggatcttgatgacccttctgctgtgaaaagagctgaaccatttgatggaatatttccacaaatgggtcttcctgttgctgcctctagtcaagtacacaaaagatatgcttcaagtttgaatgctgctcgaatggtccttgcaggatatgagcataatatcaacgaagtaaatattccatcttattatgattatactctatttagtttttttttaatcttttgtttcctttactttgatttgtgtactccatcccaaaacagtgtgattctagtgttgtcctaagtatcattagattcatcatgaaatatattttgggactgttttgagggttcacacgggttcaatgtttttttttttggttctgctgacttttcgtccaaacttgtataatctatggaaaattgtaatggtaagtacgttctgatcatgctcacatagtcacactagtgtaactttatattctagtttgataattttgagtcgcacttatttaattgaagttattgcattttgttttctatcacattgtccttagcatttatttatcacatattgattgattcgctcgaaactctttttttttccaggttgtgcaagatatgatatgctgtctggacaatccggagcttcctttcctacagtgggatgaacttatgtctgttctagcaactagacttccaagaaaccttaagagtgaggtataagacaattaccaaaatgtagccaatctgggttaaatgaaagacgattcattttactgtgtatattatcttaattttacatattggcttatgttgatgacagaaaagtttggtatcaccagagtaaaaccgtgatattttgtagcactggtttgcactgtgttacgtgcattaaagtctatagtgtgctgtagtttattatgtaaaattaagttgtattcatgtgctaaaatttagaatctttcactttagcatcttaatagatagaagctgaatcttccagtaagttttgttttagtttcttgattgtaggtctcttgtatgtccttgcataaccctttttcattctagatctgatggttctatcttttattatgcagttagaggataaataccaggaatacaagctgaacttttaccatgggaaaaataaggacttcccatccaagttgctgagagacataattgaggtcagttttagatttctttagtcgtattaattttaaactgtttgcttattttaacaatttttttgtaggcaaatcttgcatatggttcagagaaggaaaaaactacgaacgagaggcttgttgagcctcttatgagcctgcttaagtcatatgagggtggaagagaaagccatgctcattttgttgtcaaatcccttttcgaggagtatcttgctgtggaagaacttttcagtgat

SEQ ID NO: 74 - DNA, 1983 bp, Digitaria sanguinalis
gactgaagaaccattatttcttacgtgtttgtgagcttcaaatacaggtgtcgttgctaacattaaatatgtatctcttatttctcaggaagcatcaagcaggagctcaagcgttgttactgattatgttggttatctcagcaaaggtcagatcccaccaaaggtatactatatgctgagatgcccttattgcagattatgcttcttgctgtttgacttaaagcagattggtaactgtgtaattcctttctgatttgcagcacatctcactcgtcaatttgaccattgctctaaacatagaggggagcaaatacacggtactcatctatagtttttctcttaacagttttgtaacctaccactgagtgtctttgagaaaaactaaatgttaaaactttgatgtagatcgagactgtgagaggtggaccccgcagctataaattaagaatgaatggatccgagattgaagcagagatacattccctgcgagatggtggacttctaatgcaggtaaatattggacccaactgtctcctttgttttcctgttgaaaaaagttctgatcaaactttgttgtatattcttcagttggatggaaacagtcatgtaatatatgcagagacggaggctgctggtacacgccttctcatcaatggcagaacatgtttactacaggtaaacatggtattcttgttctcttccacatattttttatgctgaaacacactacctgttacatatctttacttgaaactgaagttattggatctggcaattttttacgaatgtttctttcatatgaaggtcatagaaattataggttacatagagggtagagaatacaatttaggaagctactatgacgcatagccctaagttatataaatttgcttgaacgtagatttgcttcgtcctctttatgttttcagcttggcattttccataacggtggttgttccatgtgtcaaagcatctaatgttagctagtattctcagttgccaaagataaaagatatcccagttacctactagcccactaaaagtttgtaacaatgtgaaattttacttgaaggaataagcagtttggattgtttcaattcttaaccgtattctcacatcatatggaaatacatgatattgttttttcttctcttgattatatttcacagaaagaacacgatccttcaaagttgttggctgatacaccgtgcaaacttcttcggttcttggttgcggatggctctcatgtggatgctgatacaccatatgctgaggtggaagtcatgaagatgtgcatgccactgctagtgcctgcctctggtgtcattcacttcgttatgcctgagggtcaggccatgcaggtattattcctctttatttttctccccctctgctcttgcttctttcattttataaaaaccttaaatgtatgttttcctttttttttcaggcgaatgacttaatagcaagattggaccttgatgacccatcttctgtgaggagagctgaaccgtttcatggctccttccccaaattgggacctcctactgctatttctggcaaagttcatcaaaaatttgctgcaagcgtgaattctgcacacatgatccttgcaggctatgaacataatatcaatgaggtaagacatataattatttttaatttcaaattaattttcatttttaacttccctttcattatcttcatctgcgaagaacccaatttcatggtttataacacaccacactatcgctgagagcaattgggattgcgtggaataatagattgattagggtatacatgatacaggatatataggcagccttaagaggtttatagaatcacagggcagccttgagaggtttatagaatcacaaccaatcaaggatgcctgcctttcctaaccaacagagcacagccagaggccagcacaagtcctggcacaaattccaaggaccctaccacatacacttctaacaatcc

SEQ ID NO: 75 - DNA, 7122 bp, Kochia scoparia
atgggcgagtccgattcctggacaccaatgtcgaatttgacacttcatccaagtccaaatgatattgattcaacatattggtgtaacagttataggaaaagtgggcgtattttttgccaagggcagggcggaatgttatctagggaagacccaaataaggcaacttcggagggaaaaattgattaccccaacagaacaactcttttgaggaaatctgctacattacctgttgatgaattacctgttgatgaattttgttatgctcttggagggaaaagaccgattcgtagtattttgattgcaaacaatggaatggcagctgttaaatttataagaagcattcggacatgggcttatgagaccttcggaacagagaaggctattgtattagtagcaatagctactccagaagacatgagaatcaacgctgaacacattcgaatggctgaccagtttgttgaggttcctggtgggactaacaacaacaactatgccaatgtgcagctcattgttgagatggcagagatgacacgtgttgatgctgtttggccaggctggggacatgcatcggagaaccctgagcttccagatgcactaaacgcgaaggggattgaatttctagggcctccagctaaatctatggctgctcttggagacaaaattggttcatcattgattgctcaggccgcagatgttccaactcttccatggagtggctctcatgtgaaagctcctgctgagagttgccttgattctattcctgatgacatatacaaggcagcctgtgtttttaccacagaggaagcagttgctagttgtcaggttgtcggttatccagctatgattaaagcatcttggggtggtggagggaaaggaataagaaaggtgcataatgatgatgaagtaagggcattgttcaagcaagtgcagggcgaagttcctggctctcccatatttataatgaaggtggcttcacagagtcgacacttagaagtgcagttaatttgtgatcaatatggcaatgtagcagcattacatagccgtgattgcagtgtccaaaggcggcaccagaagattattgaagagggtccaataaatgtagctccccaagaaactgtgataaaacttgagcaggcagccagaaggttagccaaatatgtgaattttgttggagcagcaactgtagaatatctatacagcatggaaactggcgagttttatttcctcgagctaaaccctcggctacaggtggagcacccagtaactgaatggattgctggaattaaccttccagctgctcaggttgcagttggcatgggtattcccctctggcaaattccagaaattcggcgattctatggtaaggaacatggtgggggttatgatgcttggagaagaacatcaattgctgcgactgcttttaattttgacaaggcacaatctgtgaaaccgaaaggtcactgtattgccgtacgtgtgacaagtgaggaccctgatgatggattcaagcccactagtgggaaagtacaggagttgattttcaaaagtaaaccaaatatgtgggcctatttctctataaagtctgggggaggcattcatgagttctcagattctcaatttggtcatgtctttgcatttggtgaatcaagagggttggccatagcaaatatggttcttggcttgaaagaaattcaaattcgtggagaaattcgcactaatgttgattataccattgatcttttaaactcttcggattacagagataataaaattcatacaggttggttagatagcagaattgcaatgagagtgaaagcggaaagacccccctggttcatctctgttgtgggaggagcactctacaaagcttttgctagtagtgcagctacagtttcagaatatgttggctatcttgagaaaggtcaaattcctccaaaggtaattcaagcaccagatgctgttgagcatatatcacttgtccactctgaagtttctctgaatattgaggggagcaagtacactattaaagtggtgaggggcggtccaggaaactacagattgagattgaatgagtctgagattgaggctgaaatacatccattaagagatgggggtcttttgatgcaattggatgggaaaagtcacgtgatatatgctcaggaagaggcagcaggaactcgccttcttattgatggacgaacgtgtttgcttcagaatgatcatgatccttcaaagttaattgtggaaacaccttgtaagctactgcggtatctggttccagatgatagtcatgttgatccagatactccttttgctgaagttgaggttatgaagatgtgtatgcctttgctttcccctgcatctggtaaaataagatttaagatgtccgaaggacaacccatgcaggctggcgaactcatagcaaaacttgagttggatgatccttcagctgtaagaaaagctgaaccgttccgtggtagttttccaaccttgcatccgccaactgctatctcagaaaaggttcatcaaaaatttgttgcaagtttgaatgcagcccagatgattcttgctggttttgaacacaacatagatgaagttgtccagagtttgttgaggtgccttgatagtcctgaacttcctttcttgcaatggcaagaatgcttgtctgttctagcaacacggcttcccaaagatctgagaactgaattggaatcaaagtgtcgaaaattcacaggaattacgaattctcataacattgaatttcctgctatggtgtttaaaggtgttcttgaggcccatttgaattcatgccctgaaaaggagagaggagctcaagagcggctcattgaacctctaatgagtcttgttaaatcctatgaaggtgggagagagagtcatgcccatgttattgttcagtctctgtttgaagagtatttgtctgttgaagaattgttcagtgtcaatatccaggctgatgtgattgaacgtctccgccttcaacataaaaatgatctatcaaaagttgttgatattgtcctatcacatcagggtgttaagaataaaaataaattgatcctccggctcatggaacaactggtttactcaaatcctgccgcatatcgggataagcttaaacatttttcacaactgaaccataaaacatactctaagttggctcgtaaggcaagtcaattgcttgaacaaacccagttgagtgaacttcgttctaatattgccagaaacctttccgagttagaaatgtttacagaagacggtgaaagcatggacgttacaaaaaggaaaagtgttattaatgaacgtatggatgctcttgttaatactccgcttgctgttgaagatgcccttgttggcttgttcgatcacagcgatcatacattacaaaggcgggttgttgagacttatatccagaggctttatcaaccttatcttgtaaagggaagtgtcaagatgcagtggcaccgatatggcctcattgcttcttgggagttcatggaggagcacattgaaagagcaaatgccgctaatgatttgtccatcaaccagcctcttgctgagaaactcattgagagaaaattgggagtcatggtcatcattaaatctcttcagtttttgccaagagtgattactgctgcattaaaagagaccacggataattcagatgaaatgattcccagaggttctttagattcaatcagtcacggaaataagttgcacattgcacttgtgggtgttaataaccagatgagctcgttgcaggatagtggtgatgaagatcaagctaaagagagaattaataagttggcgaaaatcctgagagagaaagaagtgagctcagttcttcttaacagtggtgttggggtaattagttgcattatacagagaaatggaggaagaatcccaatgaggcattcattctattggtcagaagagaaacaatactttaatgaagagcctttactacgtcatttggaacctcctctatcaatatatcttgaactggacaagctcaaacactatgaaaatcccagatatactccttctcgggatcatcagtggcacctgtatactgtcatggacaagccatctattcgacgaatgtttttgaggacacttgtcagacagcccacctccgagtttagcggggttgaactagaaatgcttaaaacacaaaggcctatctcctttacttcaagaaacatactgaggtctttaacaactgcaatggaagaattagaactcaatgcgcacaatgctaccttgaaacctgatcatgctcatatgtacctgtgcattgtaagagagcaacgaattcaagatcttgtcccatatcacagggaggtgaacattgatgatgaacaagaagagataactgttcagatatatttggaagagcttgcgcgtgaaatccacagttttgctggtgtgagaatgcataaactaaatgtatgtgagtgggaagtaaagctttgggtgtcatcttctggccaagccaatggttcatggagaatcattgttaataatgtgactggtcatacatgcactgtacatgtttaccgtgagttggaggataacaaccttcatgaaatgatctaccattcaatatctgttcaaggtcctctccatggaataccagtgaatgcaccctatcaaccacttggagtcattgcccgtaaaagacttcaggccaggaaaaatagcacaacctattgttatgacttcccactgaaagctgaaatcacccttggggacgcatgtgaagcttaccgccatccccggagacgtccccaaaagtcaacgccgttcccggaagtcaatggcgtcccgaggacgtccccaagccgtccccggcgcgtttccgtccccgttctgtccccggctttctctactgccttggagcaatcatgggcatcccaacctccgctgctgaagaaacccacaaacaaaaaagttttgaaagtctcagagctagtatttgctgatgcaaatggcacctggggaacacaagttgtcccaacagaccgtgaacctggtcttaataatattggcatggtggcctggtccatggagatgtcaactcctgaatttcctgatggaaggaccatattggttgtagcaaatgatatcaccttcatggctggatcatttgggccaaaagaagatgctctcttccgggcagttacagatcttgcttgttccaaaaaaattcctctgatttacctggctgctaattctggtgcccgactgggtgttgctgaagaggtaagagcgtgctttaaaattggttggtctgatgaactgaaccctgaacgggggttccagtatatctacttgactcctgaagattatggtcgtatagggtcagcagttatagcccatgagttagaactccaaaatggagagactcggtgggttatagacactattgtagggaaggaggatgggttaggtgttgagaacttatccggaagtgcggctatagctggtgcctattcaagggcatacaaagaaacttttacactaacttttgtaacaggaagaacagttggtattggtgcctatcttgctcgccttgggatgcgttgtatccaaaggcttgatcagcccattattctgacaggcttttcaacattaaataaacttcttggtcgtgaggtttacagctcacaaatgcaacttggtgggcccaagattatgggtacaaacggtgttgttcatttaacagtttcagatgaccttgaaggcatttcatctattatcaaatggcttagctatgttccatcctattcaggaggtgaacttcctatttcacgttctttagatcctccagaaagacaggttgagtatttgcctgacaattcttgcgatccccgttctgccatatctggtacacttgactctgatggtaattggcttggtggaattttcgacaaagatagttttgttgaaaccctacaaggctgggcaaggacagttatcactggccgcgccaaacttggtggaattccagttgggatagttgctgttgagacacaaactgtgatgcaagctatcccagctgatcctggtcagcttgattctcatgagcgagttgtctcacaagctggacaagtatggtttccggattctgcaactaagacagcacaagctttgatggattttaacagggaaggacttccacttttcattctagctaactggagagggttctctggagggcaaagggatctctttgaagggattcttcaggcaggttccacaattgtcgagaaccttaggacttataatcaacctatttttgtttatatccccatgatgggtgaacttcgtggtggcgcgtgggttgtcgtagacagtcgaatcaattcggaccagattgagatgtatgctgaccagacagcaaaaggaaatgttcttgagccagaaggaatgattgaggtgaagtttagaaccaaggaattaattgaatgtatggaaaggcttgatcaacatcttatcaatcttaatgcaaaacttgttgaagccaaaaactccaattcatcggatgacatcaaacccctcaaacagcagatagaagctcggcagaagcaacttttgcctctatatactcaaatagccacaaaatttgctgacttgcatgatagtccttatagaatggctgcgaaaggagttgtcaaggaagtcctggattggagcaattctcgctcattcttccacaaaagactgtacaggagagtaatggaggaatcacttgtcaagactgtccgagatgctgctggtgaagcaatgacccacaagtctgccttggagttgatcaagcaatggcttgctgagtctgccatggatagtactactagagcgggagctgatgcttgggctgacgatgaagctttcttcaggtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtgaattcctcaagccgagcaaatctagtagagaaactcgagaaagtgctcaattga

SEQ ID NO: 76 - DNA, 17930 bp, Kochia scoparia
actttgtagtttgtagtttgtagtgtgcagtgtgcagtgtgcagtgtcgcattaaaatttgactaatgctaatgcttccctaaaatctctcctaaacatgtgaatttccttaaattaccaccgcaaactccattcaatacttagaattattcccttgaattcgatcctactcttcagtttcatagtttcaacactcttttatttaaacttcctacaatcgtcgttctcttttttttttttgtttttcctaggcttcaaatgcagtattattattattattattagtttttcttattttacaactaaattttcatttcaacactcagaaaatttaagatgattccaatttctgagcgttgtcatgttgttaaatttcctatactcaaatcttcttctcattgccgtctcttatttcacagtgcaaatgggactatgaaatttcaactcaaaaagaggtattttcattttcatttcttagtgtcgtattttcgtaattacgttgatttttgtgtgaattgtatactagtattacaaaggatccatgattacatcgttcaattggcatagatgatgaaattgttagaaattttcgtgcaatttgcaatgcttgctttcatgattatttgtgttgttgaagggaaattcttaatcaatctcgagatatgtatttcgggtgacattttcgtaaatgaacaaaaaaccttcaaggaatttattttcactttatttacgagaatatacatagcttgagattgtttaagaaattcccgatttggaggtatcacttagaatatatatatatatatatttttatttcattattttaatcatggaaaacgatatatactcgctaactcgcatttgaattcacaacttttgtacattgtagctttctttctaggatgcataaagaacttgacactaccaactaaccggtgtttacgatgaatcatacccttttctttgagctgattttgggatgtgtcttttatattggggttggtttttggtagtgtgtagttgagctaaattaaagctctctttggtaagaagtaaaatttttttgatgcaaagtgttttcgacaattttctaattttatattgtttggttgacaaaggagtgtaaaaccattttacatggaaaacttttccaacaatattttgtacactcttgtggctacctctttgcactccttcattttcgctatttcccatattgtttatgatgcaatcaaataatggaaaattgcttccatgtaaattgctttccattctaaattgttttccttgaaaatcattttacattgtaaatattttacgccaaaccaaaattgaccctaggagtaatatagtgtgaatttatcatattgttatattcggtaatgcatactagataattgtggttcattttagttgttacttactcttctaactgtcgagtgattaatacaagtatgtgtagtccaaagtatttatattttttaaaattaaaaaaaattgcattagattgttggctcttgaattctacttgactcttgaatgtatgagtcaaaataaaacaattattagtatgtagcttttataccataatagttctgcatttcaaacaaccagtatgttctattccttttagtataaattaattctctctttctctgttaatattgtagttgtgtggtaaaatatgttaattacccaattaaaaagctgcaatcttgcaataatatgagtattgcttatgatagtagctcatgtgtttcaaagcttgtatcattttagtaagactatttgttttatgtaatacaaggttgttgtagcttgattacttttgacatgtagaatatgcatatcgtgtgaaaattgggaatgctattcatgtgataaattactcgtactctttcatttatctcacgtgggctgtgtcgacacgacttgtgtcggacaacaccgacacgcgatacttcaatcttttaactttaaacactacttttttcaagaaaatgggcgagtccgattcctggacaccaatgtcgaatttgacacttcatccaagtccaagtaacatagttcatgtgatatgatgtgattagcatgctgatcagtgttttattagatgatattgattcaacatattggtgtaacagttataggaaaagtgggcgtattttttgccaagggcagggcggaatgttatctagggaagacccaaataaggcaacttcggagggaaaaattgattaccccaacagaacaactcttttgaggaaatctgctacattacctgttgatgaattacctgttgatgaattttgttatgctcttggagggaaaagaccgattcgtagtattttgattgcaaacaatggaatggcagctgttaaatttataagaagcattcggacatgggcttatgagaccttcggaacagagaaggctattgtattagtagcaatagctactccagaagacatgagaatcaacgctgaacacattcgaatggctgaccagtttgttgaggttcctggtgggactaacaacaacaactatgccaatgtgcagctcattgttgaggtaaatcctattttactaacactgatcttcattgttttctctgatagaatatcggtttataagaaaagttataaccttgcttgttggcctgttgatgtggttcacattaaacaaccttggttcatcataggtagttcaagctccaacagttcatcgttaacacacattaattcaagtatctgttaatcattgatctcagagggtaaaccattgttaaaaggacttcaatttattttcactgcttttcagatggcagagatgacacgtgttgatgctgtttggccaggctggggacatgcatcggagaaccctgagcttccagatgcactaaacgcgaaggggattgaatttctagggcctccagctaaatctatggctgctcttggagacaaaattggttcatcattgattgctcaggccgcagatgttccaactcttccatggagtggctctcatgtatgcattgattttcttattgaccttgacaagctttctttttctcgaggagtttgctaatccgttttcttaaatttctaatctttaggtgaaagctcctgctgagagttgccttgattctattcctgatgacatatacaaggcagcctgtgtttttaccacagaggaagcagttgctagttgtcaggttgtcggttatccagctatgattaaagcatcttggggtggtggagggaaaggaataagaaaggtgagctagttgtttgggatgatgtcgtcaagaaattaaagcaccggcttcaatgcttatttatcacccttttcacagcttccatccttggacatccttttaattaactgtccattaatatttacttgacttaaatgatggacaaatgcttcaaacttgttagttagagacccgttgtgctatttcaattacaatcgtctttctctcaaaatatcacaaagactcaatagttatgcattttcaggtgcataatgatgatgaagtaagggcattgttcaagcaagtgcagggcgaagttcctggctctcccatatttataatgaaggtggcttcacaggttagttattctgcaaattggtgctagaatgtatcatataagtactcacaagtccatggcactcatgattttagaactagtactgtatgcaaaattctttgattttgacaagttattatatgtgcttcagagtcgacacttagaagtgcagttaatttgtgatcaatatggcaatgtagcagcattacatagccgtgattgcagtgtccaaaggcggcaccagaaggtgggtcactagtgtactatcaataaatttttaatcttcttgaccagttttgtattacttagggtctaaagttgtttttttcatagagaatcgtgatgctcattgttcattgaaggaatgtataaatgatcttgttcattgtattaattgatcagattattgaagagggtccaataaatgtagctccccaagaaactgtgataaaacttgagcaggcagccagaaggttagccaaatatgtgaattttgttggagcagcaactgtagaatatctatacagcatggaaactggcgagttttatttcctcgagctaaaccctcggctacaggtatgaagcatacacttgcacattgtatattcatatttacctcgaataattactcaagaaagaaaatgttttatgtcaatatttatggcattgcatctcaatatcctttggatttatcgttttctaccttacgtttgtggctcactttaatatgacttgcttttgttaaggagccttgggatttcttagagtgagatatgacactcttgcctttcaacttttgtgaaccatgtctgatactccctccatttccttttgtttgtttgatttatatcttgaggggtgatattattcataggtagagagattcctctaaatttataagatgagacatagctctgaggggtcttgttgaattcatcttgatgagtactttaaatcaaagccttgatgagtacttcaataatattaaatttttagaatttttattcttatatagttaaagatactaacaactaaaaatttgctccaacaaatgtgtgataatgaatcgggacaaaagaagggaatggagggagtattactaagaattagcaatcctatatgatcatgtgatggatgaaaaaatcttattgaagacttttctgataatattgtatataatgtctgacatatgtgtaggttttattatatttaattttaaaaaattcctgtttggaaaatccggttaattttattggttatttatctaattccttcttttgttcgcgtttgataaatacaggtggagcacccagtaactgaatggattgctggaattaaccttccagctgctcaggttgcagttggcatgggtattcccctctggcaaattccaggtagctagcatgttccctttctgattatcgaacttatgtgcttcatgttgttcttgtgcatgattgtgcttgcttttgaattatcaaaatagaaattcggcgattctatggtaaggaacatggtgggggttatgatgcttggagaagaacatcaattgctgcgactgcttttaattttgacaaggcacaatctgtgaaaccgaaaggtcactgtattgccgtacgtgtgacaagtgaggaccctgatgatggattcaagcccactagtgggaaagtacaggttagtaatactagtgtttaacagttcaaactacactctcaattgactgccttgtctgttttgtgattcatgtaaaattatttatttcattggttccttttctaggagttgattttcaaaagtaaaccaaatatgtgggcctatttctctataaaggtatgtctttattcttcaattttcacatcatccttttatggattcatccacgagcttaacaatgatcaacattgtgacgcagtctgggggaggcattcatgagttctcagattctcaatttggtaagtttaaagcacattttaaagatgactagcaatgaaatgacaattatagctgccttttaagaatgaagttcttcaacatcatattaggggttctctaatttaagtctgctgcaaatggataaggaactatgctgttgtacatgtgaaatgagatatattggtttttcgtagtgtgtcacagcagacggtaaatgctcttgttaattgttgatgattaattgggatttagcattcatggtgtaatctgctcttgcactatcaagtctcatggaattaacatgtcattttttttatcgattatttttggttttaaaacatcctttatctattttttttattttttttatagaaggctaatgttagttaatttgtttgtaggtcatgtctttgcatttggtgaatcaagagggttggccatagcaaatatggttcttggcttgaaagaaattcaaattcgtggagaaattcgcactaatgttgattataccattgatcttttaaacgtgagccttgtacatgattttttttcctccctacactttccactgttttttcaattagaagctaaacttgtcttcgtttttcctttctccagtcttcggattacagagataataaaattcatacaggttggttagatagcagaattgcaatgagagtgaaagcggaaagacccccctggttcatctctgttgtgggaggagcactctacgtatgtacaactttttttctctaaaatttgtttccttccaaaagattcacatgtcatttttcgtctttttttataacgaataattttaaatgatttctctcttctttctccctatcttcagaaagcttttgctagtagtgcagctacagtttcagaatatgttggctatcttgagaaaggtcaaattcctccaaaggtaattcaagcaccagatgctgttgaggtatactggtttttttaaacactaattgtttctttcagtaaattacatcaatttttgtgtggattgcagcatatatcacttgtccactctgaagtttctctgaatattgaggggagcaagtacactgtaagtatattattataactgatgtgaattttatatttcatttttcgatttcgtctgttttcttgttaatcatcataacatggttaatgctgttctctagattaaagtggtgaggggcggtccaggaaactacagattgagattgaatgagtctgagattgaggctgaaatacatccattaagagatgggggtcttttgatgcaagtaagaacttaacttttattcattcatatattcatgattgagggcaattgtcaaattatacacatataggagttataatatgtgtagagttaaaattgcgagtgaaagctgagatattactcgatgtatttagtatatcattcaccatagaatgcttgagttacttgcgttaaattaaaaaaaaaaaggaaagagtagaaattagagagtctaaagtttctgtggtcataatgatatgtctaattgaacgcaccccaatgtgtttcagttatttttttacccctaacttaggagggaaaactgacttagcggcttcccctctagcataggatataagtgctccaaactcttagaatatctaaatttgaaaaacttataatgtattattgacattctttcagagaatgcttttctgtgtgaactccttaagtatgttaatagcaatcccgcaaccctgtttcacattatataggtatttgtttcttattagatgatattccatatctccatataagatctttcttcttaccaattcaagccatatattttttggattaagaagatgatattcacaaaaggtttgcgttatgatgatacttaatatacccacatgtttcatattttcattgacttaaacgctatttcttagaaaagttggagttgttgatccaatgtatgtgctggtttctcatccctttgttttcaattagctatggattttgagctcttctgtacatttgaatgtgatgtagttggatgggaaaagtcacgtgatatatgctcaggaagaggcagcaggaactcgccttcttattgatggacgaacgtgtttgcttcaggtaccatcatgttatttaattgcatagtatttctaaacatttaccaagcgtaacatgctattacattttccacttcttcaatattcagaatgatcatgatccttcaaagttaattgtggaaacaccttgtaagctactgcggtatctggttccagatgatagtcatgttgatccagatactccttttgctgaagttgaggttatgaagatgtgtatgcctttgctttcccctgcatctggtaaaataagatttaagatgtccgaaggacaacccatgcaggttagcataggttttagtagatcgatatgttaactaaatatacttcaaaagtttcttctaagtgaaggttcactgtgtaggctggcgaactcatagcaaaacttgagttggatgatccttcagctgtaagaaaagctgaaccgttccgtggtagttttccaaccttgcatccgccaactgctatctcagaaaaggttcatcaaaaatttgttgcaagtttgaatgcagcccagatgattcttgctggttttgaacacaacatagatgaagtaagtattttaattgtgaattcaaaaatattgagcactatattatatagatgaagtatttcagttatgaattaagcatagatgatgtgagtattactctaagggggctgatgcaaaaatttgagagtaaatgtatatttatattttgtttggttcccttatctgaaagattctttacaaaagagttttctaattctcaggttgtccagagtttgttgaggtgccttgatagtcctgaacttcctttcttgcaatggcaagaatgcttgtctgttctagcaacacggcttcccaaagatctgagaactgaagtatgttactaaaatctgtatgcaatttttttccatatttgataaacacctgctgtctttagcagtctttatcttctttggtctttccctctctctctctctctctctctcaccctgtgtataattcacattatttttccatgtttccctgtctttggtattctcagttggaatcaaagtgtcgaaaattcacaggaattacgaattctcataacattgaatttcctgctatggtgtttaaaggtgttcttgaggttagtctttctttttgctacccttctatatatgctatatattttagtattacttacataagtattttgtttacaggcccatttgaattcatgccctgaaaaggagagaggagctcaagagcggctcattgaacctctaatgagtcttgttaaatcctatgaaggtgggagagagagtcatgcccatgttattgttcagtctctgtttgaagagtatttgtctgttgaagaattgttcagtgtcaatatccaggtttgttattgccgtgcaaattaatcagtttatcgatgatcattggtctttatgttttttcctcgattggtagattggttatgatgttatgactctagagtaaaggtggaaccagaaaaatgttttggagggggccaaaatatttgttttgtattattggagggggccgaatacaaaaattagcttaatttttcccatatttaacctattttttaaagaaaaataaaaaattggcgggagtcgtggcccccacccgcccccatgttctgccattgccctagaggctacagaatctttggagtaccttatgtctcagtgaattatagtagcatcctttgaagtattactttgttttttcaagaaatagcagttcatgtctttggttgttggcttgtaatttgtgcactgtaatgcaagcttaggactagaagaaacagtttatttatacgctatgaattatgatcctggtaggctggcatcgttccactgtaatatgattctgatttcaatctatacaggctgatgtgattgaacgtctccgccttcaacataaaaatgatctatcaaaagttgttgatattgtcctatcacatcaggtaagcaggaaatttcaaataatacaaaataaaattttctgagttttctttttattttcttttcttttttttcccactttcccttgtactgtcttctagacttgtttactgtgtagtaataatggttttcagggtgttaagaataaaaataaattgatcctccggctcatggaacaactggtttactcaaatcctgccgcatatcgggataagcttaaacatttttcacaactgaaccataaaacatactctaaggttagagatgattcaactttttgcattattgtcacactacaacattcacaaaaaggtcattaagtttatacactaattaattccttcgctatatgcagttggctcgtaaggcaagtcaattgcttgaacaaacccagttgagtgaacttcgttctaatattgccagaaacctttccgagttagaaatgtttacagaagacggtgaaagcatggacgttacaaaaaggaaaagtgttattaatgaacgtatggatgctcttgttaatactccgcttgctgttgaagatgcccttgttggcttgttcgatcacagcgatcatacattacaaaggcgggttgttgagacttatatccagaggctttatcaagtaatatctaagtttcaacattaaactttaacaatcatttgataatattatgtcatttaactctcttttttgtgggtaacctcttttctcagccttatcttgtaaagggaagtgtcaagatgcagtggcaccgatatggcctcattgcttcttgggagttcatggaggagcacattgaaagagcaaatgccgctaatgatttgtccatcaaccagcctcttgctgagaaactcattgagagaaaattgggagtcatggtcatcattaaatctcttcagtttttgccaagagtgattactgctgcattaaaagagaccacggataattcagatgaaatgattcccagaggttctttagattcaatcagtcacggaaataagttgcacattgcacttgtgggtgttaataaccagatgagctcgttgcaggataggtatagattctatccttgtagtttcagcaagattttaaatgtggacattattggaccatccggtttttttgaagaaatatgctttgcttcaattatacagttgctcttaatattatccattccagccttttgcttaaccttttttgtctttgtggtttatgaaatttatttttatactattcagtggtgatgaagatcaagctaaagagagaattaataagttggcgaaaatcctgagagagaaagaagtgagctcagttcttcttaacagtggtgttggggtaattagttgcattatacagagaaatggaggaagaatcccaatgaggcattcattctattggtcagaagagaaacaatactttaatgaagagcctttactacgtcatttggaacctcctctatcaatatatcttgaactggtaataaaattctgagcaagaagctgttgctttgtttgttcgttcttttcttgttttttaatatgggccaaatcattatctttaatatttttatcactatatgatatagttataaggtatttggctcacaattttcattatacaggacaagctcaaacactatgaaaatcccagatatactccttctcgggatcatcagtggcacctgtatactgtcatggacaagccatctattcgacgaatgtttttgaggacacttgtcagacagcccacctccgagtttagcggggttgaactagaaatgcttaaaacacaaaggcctatctcctttacttcaagaaacatactgaggtctttaacaactgcaatggaagaattagaactcaatgcgcacaatgctaccttgaaacctgatcatgctcatatgtacctgtgcattgtaagagagcaacgaattcaagatcttgtcccatatcacaggttctaattaatcatcttaattttctgtgtttcattcgtggtcattgatgcaacttatgccttaatagatattattttgacccattgatccagggaggtgaacattgatgatgaacaagaagagataactgttcagatatatttggaagagcttgcgcgtgaaatccacagttttgctggtgtgagaatgcataaactaaatgtatgtgagtgggaagtaaagctttgggtgtcatcttctggccaagccaatggttcatggagaatcattgttaataatgtgactggtcatacatgcactgtacatgtaagtttgaattttgattatttttcctataactttctgtacatcaaccatgtttagtgatttctttcaacactctgatatttatgccagtttttgtaagaattatagaaatacagtagcaatgttttgatagcccaggttctctctttctcccaaattaatctttgtgtcaatgcatgactttgccgcatcaatatcttaaataatttatgattataaactataagaatatgatactatgagaaattgaaaatatacatcgagagaaatctaaatacaccttccataacctttgatttattattttattttttaatggaaaaacaatgggcaaaggtgatacatgaatcatgtaaaacacaaactttgattttacatatgggatgaagggactagtaatggtttgtatattggcactgacaaagaaaagtttattcatgattaatttacgtcttgtatacgtgtatcacataatgtcttctttagtttgatgaccttttttctactaatgttatgcaggtttaccgtgagttggaggataacaaccttcatgaaatgatctaccattcaatatctgttcaaggtcctctccatggaataccagtgaatgcaccctatcaaccacttggagtcattgcccgtaaaagacttcaggccaggaaaaatagcacaacctattgttatgacttcccactggtaagaaatattaaactccactataccccaatactacaaaagcagaattttactatattaggtttccttccctcccgaatttttttaaaaaataagagttaatacatgacttgcattcgagtgtaactatgttcttattaacgctcaactagtaatgcaatgggaatataaatctaaattctaagagggaggtggggttcagtaactgtgggactaggttgcaccgatacgggtacggggacatatacgggtacgggaacggggacgggaaacgacaattttaaaaattcttgggtacggggacggatttgggaacgacaatttattaaatataaatttttattttaaaaaaaaatgagcattgtgatcattttaataaaaaaaatgcaacaaaataaaaatcatagttaatacaaataatttagtccaaagtaaaaggcaagtagacaacatttaattttttttaaacataaccagaaaacataaatttaatagggtaaataaaaaatggtgaaatccaaaaaattaaataaatgacacaaataagcacacattcacaaccacacatttacaaatcacaaattcacaaccacataaaatgaattaaagtggaatagtttactgacatgctttggaagacaatagaaaaagtgaaagagaagattagaagaagaaagtgagatttaagaagccacgaagtgaagcctagcgccatagtggaatagtcaagcctcaacatcgtcgaatagtgtagccttgcgccatcgccattgagagtgagtggcagaaccaccgtttgccgtcaccgtggtgtaatgcatcgtcgtcgagaggaagagagagagaccctagaatttgaaattggtttgttttttgttgtgccaagtggtttattcaacattctattgtaattttgttgttttataaactaaaagaaagctgaaatcacccttggggacgcatgtgaagcttaccgccatccccggagacgtccccaaaagtcaacgccgttcccggaagtcaatggcgtcccgaggacgtccccaagccgtccccggcgcgtttccgtccccgttctgtccccggtacgggggacgctggctatgtggcgtccccgtgcaacatagctgtgggaccttgtaaaggtttaaagtttggtggagatgctgggtttataattagtttaggacgaaactgccaagttttctattgtatgtaatttattggttatgaaagtaaaaaatcgtgattgttatgcaaatgattgtacctatagtgattgtgtgacaatgttgtcaaatgtataagcattgcaatttttttgagataagggaaccgtaaataaaaatacaacgcatggcttggatgttaccgtcattaccgatttttgtcctatgtagtggtatctcaaatttttatatttcactttggagcgatcaacttgctttaggtgctagtatttatctgtttttctatgggaaaattgacttgtaattgttgggaatgtttttcttaggctttctctactgccttggagcaatcatgggcatcccaacctccgctgctgaagaaacccacaaacaaaaaagttttgaaagtctcagagctagtatttgctgatgcaaatggcacctggggaacacaagttgtcccaacagaccgtgaacctggtcttaataatattggcatggtggcctggtccatggagatgtcaactcctgaatttcctgatggaaggaccatattggttgtagcaaatgatatcaccttcatggctggatcatttgggccaaaagaagatgctctcttccgggcagttacagatcttgcttgttccaaaaaaattcctctgatttacctggctgctaattctggtgcccgactgggtgttgctgaagaggtaagagcgtgctttaaaattggttggtctgatgaactgaaccctgaacgggggttccagtatatctacttgactcctgaagattatggtcgtatagggtcagcagttatagcccatgagttagaactccaaaatggagagactcggtgggttatagacactattgtagggaaggaggatgggttaggtgttgagaacttatccggaagtgcggctatagctggtgcctattcaagggcatacaaagaaacttttacactaacttttgtaacaggaagaacagttggtattggtgcctatcttgctcgccttgggatgcgttgtatccaaaggcttgatcagcccattattctgacaggcttttcaacattaaataaacttcttggtcgtgaggtttacagctcacaaatgcaacttggtgggcccaagattatgggtacaaacggtgttgttcatttaacagtttcagatgaccttgaaggcatttcatctattatcaaatggcttagctatgttccatcctattcaggaggtgaacttcctatttcacgttctttagatcctccagaaagacaggttgagtatttgcctgacaattcttgcgatccccgttctgccatatctggtacacttgactctgatggtaattggcttggtggaattttcgacaaagatagttttgttgaaaccctacaaggctgggcaaggacagttatcactggccgcgccaaacttggtggaattccagttgggatagttgctgttgagacacaaactgtgatgcaagctatcccagctgatcctggtcagcttgattctcatgagcgagttgtctcacaagctggacaagtatggtttccggattctgcaactaagacagcacaagctttgatggattttaacagggaaggacttccacttttcattctagctaactggagagggttctctggagggcaaagggatctctttgaagggattcttcaggcaggttccacaattgtcgagaaccttaggacttataatcaacctatttttgtttatatccccatgatgggtgaacttcgtggtggcgcgtgggttgtcgtagacagtcgaatcaattcggaccagattgagatgtatgctgaccagacagcaaaaggaaatgttcttgagccagaaggaatgattgaggtgaagtttagaaccaaggaattaattgaatgtatggaaaggcttgatcaacatcttatcaatcttaatgcaaaacttgttgaagccaaaaactccaattcatcggatgacatcaaacccctcaaacagcagatagaagctcggcagaagcaacttttgcctctatatactcaaatagccacaaaatttgctgacttgcatgatagtccttatagaatggctgcgaaaggagttgtcaaggaagtcctggattggagcaattctcgctcattcttccacaaaagactgtacaggagagtaatggaggaatcacttgtcaagactgtccgagatgctgctggtgaagcaatgacccacaagtctgccttggagttgatcaagcaatggcttgctgagtctgccatggatagtactactagagcgggagctgatgcttgggctgacgatgaagctttcttcaggtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtatctctaaggttcctccacacacacacacaccccacccaccaaaaaaaacacacacacacacattcacaagaaaagtagaattgctagtgaaataacttcatcgtgttcaatgcaggtgaattcctcaagccgagcaaatctagtagagaaactcgagaaagtgctcaattgatttggtaatgatcctgcagaaaaacctcttggtatatggtggtatgcaaatgccatatctgaaagattgattaggcaagttgagacagagacaggcacagttgtaataatgggatctatcaaaccagaagacgttataactaagctcaaagatgatggtgattttgaccgtcttcgtctcaaaatcattcgtaagctcaaacaaaacgtatttctttctccttttcatcttctactgtatattaaatggtttaaaatttgatcttgattaatgggtaatctttataattttatcttttttattataatacaagaatgatatgcatatttttattttgttattaattaccaaatgcacttcagtttacattgccggttttgaagttttggaagcagaattggggttagaatgctagatattattgcttgttgatcatttattcagttacttacattgtttggttgaaatcggaattaaaagagcacaaattgtatggtttctaactcgacttcacaataagagtatagatgctcactgttgtgttgtgtgttttgtttttgttaagaaatattggttttgattgatgatgctccaagcctcgagtgagcgtgttgatgaaatagagtactgaattaaaggttatcattttatcgaatgtcagattaattgttaattgttgctcggagtcggagtttaaatgagaatcattttatcgaatgtcttaagttatcagggcagatattttttttctagtgggtatggactcttgagcctcttttttctgtatcaaactgtcctgttggttgttcaaattatgcaaatcatgaagagattactttggtctcaggtttgcttcgccatccttcccaatgaatcgtcaggattcattttcaattaaatcttatgtattcacgggttccttcgtcccggtcgcttcttagttaatgttctagcccggagccttgttgttggatggtttgatctactatagagttcattttctgacttgtttggcatttgttaatgggcattgatacgagttgtttaccgtattaaattaattatttataaaatttatcttagtcgttcaaaaatatatacaagtaatttaaaattcaatctaaagtgaagtataagtacatatacacataatatttacgctatttacagaattatactaataatcgaattaaaataagtcaattagagtagtaaaggaattaacaaggtatttaactaaaacaattgatgagtaagaagaactgatgaatttgtactcaagaacacccaaacgatactccgcttcaacctcacgactcgatgtcattctcgttcgaccttgaattcaagactaagctacctttcaattgttgtctcctcttccaattgctccaatcgaaaatcctatcaaaactcttactctcaattgctctcaaaatatcggctaagttgtgtgtcaacaataggtctattatggtcctgagaccatgtgg

SEQ ID NO: 77 - DNA, 12931 bp, Kochia scoparia
aatagtaaaaacctagtgaactttgtagtttgtagtttgtagtgtgcagtgtgcagtgtgcagtgtcgcattaaaatttgactaatgctaatgcttccctaaaatctctcctaaacatgtgaatttccttaaattaccaccgcaaactccattcaatacttagaattattcccttgaattcgatcctactcttcagtttcatagtttcaacactcttttatttaaacttcctacaatcgtcgttctcttttttttttttgtttttcctaggcttcaaatgcagtattattattattattattagtttttcttattttacaactaaattttcatttcaacactcagaaaatttaagatgattccaatttctgagcgttgtcatgttgttaaatttcctatactcaaatcttcttctcattgccgtctcttatttcacagtgcaaatgggactatgaaatttcaactcaaaaagaggtattttcattttcatttcttagtgtcgtattttcgtaattacgttgatttttgtgtgaattgtatactagtattacaaaggatccatgattacatcgttcaattggcatagatgatgaaattgttataaatatcgtgcaatttgcaatgcttgctttcatgattatttgtgttgttgaagggaaattcttaatcaatctcgagatatgtatatcgggtgacattttcgtaaatgaacaaaaaaccttcaaggaatttattttcactttatttacgagaatatacatagcttgagattgtttaagaaattctcgatttggaggtatcacttagattgtttaatttcattattttaatcatggaaaacgatatattctcgctaactcgcatttgaattcacaacttttgtacattgtagctttctttctaggatgcataaagaacttgacactaccaactaaccggtgtttacgatgaatcatacccttttctttgagctgattttgggatgtgtcttttatattggggttggtttttggtagtgtgcagttgagctaaataaaagctctctttggtaagacgtaaatttttttgatgcaaagtgttttcgacaattttctaattttatattgtttggttgacaaaggagtataaaaccattttacatggtaaacttttccttcaatattttgtacactcttctggctacctctttgcactccttcattttcgctattttccatattgtttatgatgcaatcaaataatggaaaattgcttccatgtaaattgctttccattgtaaattgttttccttgaaaatcattttacattgaaaatattttacgccaaaccaaaatgaccctaggagtaatatagtgtgaatttatcatattgttatattcggtaatgcatactagataattgtggttcattttagttgttacttactcttctaactgttgagtgattaatacaagtatgtgtggtccaaagtatttatattttttaaaattaaaaaaaattgcattagattgttggctcttgaattctacttgactcttgaatgtatgagtcaaaataaaacaattattagtatgtagcttttataccataatagttctgcatttcaaacaaccgtatgttctattccttttagtataaattaattctctctttctctgttaatattgtagttgtgttgtaaaatatgttaattacccaattaaaaagctgcaatcttgcaataatatgagtattgcttatgatagtagctcatgtgtttcaaagcttgtatcattttagtaagactatttgttttatgtaatactaggttgttgtagcttgcttgcttttgatatgtagaatatgcatatcgtgtgaaaattgggaatgctattcatgtgataagttactcgtactctttcatttatctcacgtgggctgtgtcgacacgacttgtgtcggacaacaccgatacgcgatacttcaatcttttaacttagaacactacttttttcaagaaaatgggcgagtccgattcttggacaccaatgtctaatttgacacttcatccaactccaagtaacatagttcatgtgatatgatgtgattagcatgctgatcagtgttttattagatgatattgattcaacatattggtgtaacagttataggaaaagtggacgtattttttgccaagggcagggcggaatgttatctagggaagacccaaataaggcaactccggagggaaaaattgattaccccaacagaacaactcttttgaggaaatctgctacattacccgttgttgatgaattttgttatgctcttggagggaaaaagccgattcatagtattttgattgccaacaatggaatggcagctgttaaatttatcagaagtgttcggacatgggcttacgaaacttttggaacagagaaggctattgtattagtagcaatggctactccagaagacatgagaatcaacgctgaacacattcgaatggctgaccagtttgttgaggttcctggtgggactaacaacaacaactatgccaatgtacagctcattgttgaggtaaatcctgctttagtaacactgatcttccgtgttttctctgttagattacgaaatactcacattagccacagtgtatgagaaaagatatcacctgtcctgttggcctgttgatgttcatcattgatttcagaggataaaattttgttaaaaagacttcaatttattttcactgctctttcagatggcagaaattacacgcgtagatgcagtttggccaggttggggacatgcatctgagatccctgagcttccagatgcactaaccgcaaaggggattgaatttctagggcctccagctatatctatggctgctcttggagacaaaatcggttcatcattgattgctcaggccgcagatgttccaactcttccatggagtggctctcatgtatgaattgattttcttatcgaccttcacaaactttctttttctcaaggagtttcctaatcagttttcttaaatttctatgctttaggtgaaagttcctgctgagagttgccttgatactattcctgatgatatatacaaggcagcctgtgtttttaccacagaggaagcagttgctagttgtcaggttgtcggttatccagctatgattaaagcatcttggggtggtggagggaaaggaataagaaaggtgagctagttgtttgggatgatgtcgtcaagaaattaaagcaccggcttcattgcttatttatcacccttttcacagcttccatccttggacatccttttaattaactgtccagtaatatttactagacttaaatgatggacaaatgcttcaaacttgttagttagagacccgttgtgctatttcaattacaattgtctttctctcaaaatatcacaaagactcaatagttatgcattttcaggtgcataatgatgatgaagtaagggcattgttcaagcaagtgcagggcgaagttcctggctctcccatatttataatgaaggtggcttcacaggttagttattctgcaaattggtgctagaatgtatcatttaagtactcacaagtccatggcactcatgattttagaactagtactgtacgcaaaattctttgattttgacaagttattatatgtgcttcagagtcgacacttagaagtgcagttaatttgtgatcaatatggcaatgtagcagctttgcatagccgtgattgcagtgtccaaaggcggcaccagaaggtgggtcactagtgtactatcaataaatttttaatcttcttgaccagttttgtattacttagggtctaaagttgtttttttcatagagaatcgtgatgctcattgttcattgaaggaatgtataaatgatcttgttcattgtattaattgatcagattattgaagagggtccaataaatgtagctccccaagaaactgtgataaaacttgagcaggcagccagaaggttagccaaatatgtgaattttgttggagcagcaactgtagaatatctatacagcatggaaactggcgagttttatttcctcgagctaaaccctcggctacaggtatgaagcatacacttgcacattgtatattcatatttacctcgaataattactcaagaaagaaaatgttttatgtcaatatttatggcattgcatctcaatatcctttggatttatcgttttctaccttacgtttgtggctcactttaatatgacttgcttttgttaaggagccttgggatttcttagagtgagatatgacactcttgcctttcaacttttgtgaaccatgtctgatactccctccatttccttttgtttgtttgatttatatcttgaggggtgatattattcataggtagagagattcctctaaatttataagatgagacatagctctgaggggtcttgttgaattcatcttgatgagtactttaaatcaaagccttgatgagtacttcaataatattaaatttttagaatttttattcttatatagttaaagatactaacaactaaaaatttgctccaacaaatgtgtgataatgaatcgggacaaaagaagggaatggagggagtattactaagaattagcaatcctatatgatcatgtgatggatgaaaaaaaaaattcttatttgacttttctgacaatattgtatataatgtctgacatatgtgtaggttttattatatttaattttaaaaaattcctgtttggaaaatccggttaattttattggttatttatctaattccttcttttgttcgcgtttgataaatacaggtggagcacccagtaactgaatggattgctggaattaaccttccagctgctcaggttgcagttggcatgggtattcccctctggcaaattccaggtagctagcatgttccctttttttattatataacttatgtgcttcatcttgttcttgtgtatgagttggcttgcttttgcaatttcaaaatagaaattcggcgattctatggtaaggaacatggtggcggttatgatgcttggagaagaacatcagttgcagcgactccttttgattttgacaaggcacaatctgtgaaaccaaaaggtcactgtactgccgtacgtgtgacaagtgaggaccctgatgatggattcaagcccactagtgggaaagtacaggttaataatgctattgttttatagttcaaactattttctcaattgattgccttgtctgttttgtgattcatgtaaaattatttaattcattggtttcttttctaggagttgagtttcaaaagtaaaccaaatgtgtgggcctatttctctgttaaggtatgtctttattttttttaagctttacatcatccttttatggattcatccacgagcttaacaatggtcaacactgtcaattgcagtctgggggaggcattcatgaattctcagattctcaatttggtaagtttaaagcacattttaaagatgactagcaatgaaatgactattatagctgccttttaagaatgaagttcttcaacatcatagtattcattctctaatttaagactgctgcaaatggattgagaactgtgctgttgtgcatgtgaaatgagatatattggtttttcatagtgtgtcattgtagacagtaaatgctcttgttaattgttgatgattggaattgggatttagcatgcttggtgtagttttctcttgcacaaacaagtctcatggaattaacatgtcattttttttatcgattatttttggttttaaaacatcctttatctattttttttattttttttatagaaggctaatgttagttaatttgtttgtagggcatgtctttgcatttggtgaatcaagagggttggccatagcaaacatggttcatggcttaaaagaaattcaaattcatggagaaattcgcacgaatgttgattataccattgatcttttaaacgtgagccttgtacatgattttttttcctccctacactttccactgttttttcaattagaagctaaagttgtctttgtttttcctttctccagtcttcggattacagagataataaaattcatacaggttggttagatagcagaattgcaatgagagtgagagcggaaagacccccctggttcatctctgttgtgggaggagcactctacgtatgtacagctttttttctctaaaatttgtttccttccaaaagcttcatgtgtcactttcgtttatttttataatgaataattttaaatacttcgtaatttctttctcctttctccctatcttcagaaagcttttgctagtagtacagctacagtttcagaatatgttggctatcttgagaaaggtcaaattcctccaaaggtaattcatgcaccagacgctgttgaggtatactggtttttttaaacactaattgtttctttcagtaaattacatcaatatttgtgtggattgcagcatatatcacttgtccactctgaagtttctctgaatattgaggggagcaagtacactgtaagtatattattataactgatgtgaattttatatttcattttcgatttcttctgttttcttgttaatcatcataacatggttgatgctgttctctagatcaaagtggtgaggggcggtccaggaaactacagattgagattgaatgagtctgagattgaggctgaaatacatccattaagagatgggggtcttttgatgcaagtaagaacttaacttttattcattcatatattcatgattgagggcaattgtcaaattatacacatataggagtgataatatgtgtagagttaaaattgcgagtgaaagctgagatattactctatgtatttagtatatcattcaccatagaatgcttgagttacttgcgttaaattaaaaaaaaaggaaagagtagaaattagagagtctaatttctgtggtcacaatgatatgtctaattgaacgcacccaatgtgtttcagttatttttttacccctaacataggagggaaaactgacttagcggcttcccctctagcataggatataagtgctccaaactcttagaatatctaaatttgaaaaacttataatgtattattgacattctttcagagaatgcttttctgtgtgaactccttaagtatgttaatagcaatcccgcaaccctgtttcacattatataggtatttgtttcttattagatgatattccatatctccatataagatctttcttcttaccaattcaagccatatattttttggattaagaagatgatattcacaaaaggtttgcgttatgatgatactcaatatacccacatgtttcatattttcattgacttaaacgctatttcttagaaaagttggagttgttgatccaatgtatgtgctaggttctcatccctttgttttcaattagctatggattttgagctcttctgtacatttgaatgtgatgtagttggatgggaaaagtcacgtgatatatgctcaggaagaggcagcaggaactcgccttcttattgatggacgaacgtgtttgcttcaggtaccatcatgttatttaattgcatagtatttctaaacatttaccaagcgtaacatgctattacattttccacttcttcaatattcagaatgatcatgatccttcaaagttaattgcggaaacaccttgtaagctactgcggtatttggttccagatgatagtcatgttgatccagatactccatttgctgaagttgaggttatgaagatgtgtatgcctttgctttcccctgcatctggtaaaataagatttaagatgtccgaaggacaacccatgcaggttagcataggttttggtagatctatatgttaactaattatacttcaaaagtttcttctaagtgaaggttcactgtgtaggctggcgagctcatagcaaaacttgagttggatgatccttcagctgtaagaaaagctgaaccgttccgtggtagttttccaaccttgcatccgccaactgctatctcagaaaaggttcatcaaaaatttgttgcaagtttgaatgcagcccagatgattcttgctggttttgaacacaacatagatgaagtaagtattttaatagtgaattcaaaaatattgagcactatattatatagatgaagtatttcagttatgaattaaacatagatgatgtaagtattactctaagggggctgatgcaaaaatttgagagtaaatgtatatttatattttgtttggttcccttatctgaaagattctttacaaaagagttttctaattctcaggttgtccagagtttgttgaggtgccttgatagtcctgaacttcctttcttgcaatggcaagaatgcttgtctgttctagcaacacggcttcccaaagatctgagaactgaagtatgttactaaaatctgtatgcaatttttttccatatttgataaacacctgctgtctttagcagtctttatcttctttggtctttctccctctctctctctctctctcaccctgtgtataattcacattatttttccatgtttccctgtctttggtattctcagttggaatcaaagtgtcgaaaattcacaggaattacgaattctcataacattgaatttcctgctaagctgtttaaaggtgttcttgaggttagtctttctttttgttacccttctatatatgctatatattttagtattacttacataagtattttgtttacaggcccatttgaattcatgccctgaaaaggagagaggagctcaagagcggctcattgaacctctaatgagtcttgttaaatcctatgaaggtgggagagagagtcatgcccatgttattgttcagtctctgtttgaagagtatttgactgttgaagaattgttcagtgacaatatccaggtttgttattgcagttgcaaattgatcagtttttttggtcaaccaatttgtaccgggacaaattgccacagtcctaatttattgatgatcatcggtcttcgtgtttttttcccggtttggttgattggttatcatgttatgaagttgtcacataaaaaaacctaaatttactaatgcacccatttgaccctagaggctacagagtctttggagtactctgtctctgtggatttatagtagcatcctttgaagtattactttattttttcaagaaattgtagttcatgtcttttgattctgatcttgaaaggaaggctgacatcattccactttattttctaatttcaatctatacaggctgatgtgattgaacgtctccgccttcaacataaaaaagacctgttaaaggttgttgacattgtcctatcacatcaggtaggcaggaaatttcaaataatacaaaataaaattttctgagttttctttttattttcttttcttttttttcccactttcccttgtactgtcttctagacttgtttactgtgtagtaataatggttttcagggtgttaagaataaaaataaattgatcctccggctcatggaacaactggtttactcaaatcctgccgcatatcgggataagcttaaacatttttcacaactaaaccatacaatctactctgaggttagtgattattcaattttttgtttatattgtcacactacagcattcacaaaaaggttattaagtttatacactaatcaattccttcactatatgcagttggcacttaaggcaagtcaattgcttgaacaaaccaagttgagtgaacttcgttctaatattgccagaaacctttccgagttagaaatgtttacagaagatggtgaaaacatggacactccaaaaaggaaaagtgctattaatgagcgtatggaggctcttgtgaatactccgcttgctgttgaagatgcccttgttggcttgttcgatcacagcgatcatacgttacaaaggcgggttgttgagacttatgtccggagactttatcaagtaatatctaagttccaacagtaaactttaactatcatttaataatgttatgtcatataactctattttttgtgggtaatctcttttctcagccttatcttgtaaaaggaagtgtcaggatgcagtggcacagatctggcctcattgtttcttgggagttcatggaggagcacattgaaagagcaaatgcctctaatgatctgtccatcaaccagccccttgttgagaaacacagtgagagaaaatggggagccatggtcatcataaaatctcttcagtttttgccaacagtgattactgctgcattaaaagagacaacacataattcagatgaaacgattcccagaggctctttagaatcaatcagtcatggaaatatgttgcacattgcacttgtgggtgttaataaccagatgagcttgttgcaggataggtatagattctatttttatggtttaagcaagattttaaaatgtgaacattggactatccaattttatttatgtttatttatttatttatttttttgacgaggactatccagtttttttgaagaaatatgctttgcttcaattatgcagtcgctctttatagtaaccattccggccttttgcttaacctttttttctctgtggggtttatgaaatggaattttatactatgcagtggtgatgaagatcaagctcaagagagaattgataagttggcaaaaatcctgagagagaaagaagtgagctcaggtcttcgtgacgttggtgtcagggtaattagttgcattatacagagagatgaaggaagaacgccaatgaggcattcattctattggtcagaagagaaacaatacttcaatgaagagcctttactacgtcatttggaacctcctctatcaatatatcttgaactggtaataaaattctgagcaagaagctgttgctttgtttgttcgttcttttcttgttttttaatatgggccaaatcattatctttaatatttttatcactatatgatatagttataaggtatttggctcacaattttcattatacaggacaagctcaaacactatgaaaatcccagatatactccttctcgggatcatcagtggcacctgtatactgtcatggacaagccatctattcgacgaatgtttttgaggacacttgtcagacagcccacctccgagtttagcggggttgaactagaaatgcttaaaacacaaaggcctatctcctttacttcaagaaacatactgaggtctttaacaactgcaatggaagaattagaactcaatgcgcacaatgctaccttgaaacctgatcatgctcatatgtacctgtgcattgtaagagagcaacgaattcaagatcttgtcccatatcacaggttctaattaatcatcttaattttctgtgtttcattcgtggtcattgatgcaacttatgccttaatagatattattttgacccattgatccagggaggtgaacattgatgatgaacaagaagagataactgttcagatatatttggaagagcttgcgcgtgaaatccacagttttgctggtgtgagaatgcataaactaaatgtatgtgagtgggaagtaaagctttgggtgtcatcttctggccaagccaatggttcatggagaatcattgttaataatgtgactggtcatacatgcactgtacatgtaagtttgaactatgataattttttcctataattttctgtaaaggtttttagtattggccgtgtttagtaatttctttcaacactcagatatttatgccagtttttgtaagaattatagaaatacagtagcaatgttttgatagcccaggttctctctttctcccaaattaatctttgtgtcaatgcatgactttgccgcatcaatatcttaaataatttatgattataaactataagaatatgatactatgagaaattgaaaatatacatcgagagaaatctaaatacatcttccattacaacctttgatttttttttttttttttaaattgaaaaaacaatgggtaaaggtgatacatgaatcttgtaaaacacaaacaatgaccatacatatgggacggagggagtaataatggtttgtatattggcacttataaagaaaaaggttatgcacaattaatttatgtcttgtagacgtgtatcacataatgtcttctttagtttgctgaccttttttctactaatgttatgcaggtttaccgtgagttggaggataacaaccttcatgaaatgatctaccattcaatatctgttcaaggtcctctccatggaataccagtgaatgcaccctatcaaccacttggagtcattgcccgtaaaagacttcaggccaggaaaaatagcacaacctattgttatgacttcccactggtaagaaatattaaactccactataccccaatactacaaaagcagaattttactatattaggtttccttccctcccgaatttttttaaaaaataagagttaatacatgacttgcattcgagtgtaactatggttcttgtttacgctcaactagtaatgaaataggaatataaatctaataaagatttacaaattttggagagaggcggggttgtgtaactgtgggactttgtaaaggtttaaagttagttaggtggagatgcagggtttatatttagtttatgaggaaactacaagttttcaagattttaataggtaatacgtgtaaaattttaaaagatatcggaatatttgtcttagtattttggattattgtaactttgtaaataaaaatagtttcacattttgttaagatttcaagtttggctttcgcacacaatgggtctgttcttttcaccttatctgtacttatccgaacttttccgaacttctatgaacttgttttgtgagagagaaaa

SEQ ID NO: 78 - DNA, 10030 bp, Kochia scoparia
atgtctttgcatttggtgaatcaagagggttggccatagcaaatatggttcttggcttgaaagaaattcaaattcgtggagaaattcgcactaatgttgattataccattgatcttttaaacgtgagccttatacatgaatttcccccctacactgttcactgttttttcaattagaagctaaacttgtctttgtttttcctttctccagtcttcggattacagagataataaaattcacacaggttggttagatagcagaattgcaatgagagtcagagcggaaaggcccccctggttcatctctgtggtgggaggtgcactctacgtatgtacaacttttctcttaaattttcttccttcctcaagcttcatgtgtcactttcgtttatttttataatgaataattttaaatgattctttctcctttctccctatcttcagaaagcttctgctagtagtgcggctactgtttcagaatatattggctatcttgagaaaggtcaaattcctccaaaggtaatccaaataccagatgctgttgagatatacttgttttttaaacactaattgtttctttcagtaaattacatcaacatttgtgtggattgcagcatatatcacttgtccactcggaagttactttgaatattgaggggagcaagtacactgtaagtttattattaactgatgtgaattttatttttcgttcatggtttctcctgtttacttgttgttaatcatcataacatggttgattctgttctccagatcaaaatggtgaggggcggtccaggaagctacagattgagattgaacgagtcagagattgaggcagaaatacatacattaagagatgggggtcttttgatgcaagtaagaacttaattttattgattcatatattcatgattgaggacaattataaacctcaagctatacgcataggaattataatttgtatagagagttaaaattgcgagtgaaagctaagatattgcaccaacatgtattaagtctatcatccaccacataatgctgaagttacctccgttaattaaatttaaaaaacaggagagtgtagaaattagatagtctaagtttctgtagtcataatgatatgtcttttggaaagtgccccaatgtgttacatttatcttttacccctaacttagtttaggagggaaagctgacttagcaacttctcctctagtacaggatataaatgctcaaaactcttagaatatctaaatttgaaaagattataatgtattattgacattgtttcagagaatgattttctgtatgaactccttaagtatgttttttgacaactccttaagtatgttaatagcaatgccacaaccctgttccacattaggtaggtatatatgtttctgattagaaattatattccatatctccgtataagatcttccttcttaccaacacgagccatataattttgggattaagtagatgatgttggtttgcattatgatgatacttaatatacccacatgtttcatattttcattgacttaaacgctatcttctagaaaaggggtagttgttgatccaatgtatgtgctacattctcatccctttgatttcaactagctatggattttgagctattctgtgcatttgaatgtgatgcagttggatgggaacagtcatgtgatatatgctgaggaagaggcagcaggaactcgccttcttattgatggacgaacatgtttgcttcaggtaccatcttgttatttaattgcataatatttctaaatctttaccaagcgtaacctagtattaaatatcccccttctttgtatccagaatgatcatgatccttcaaagttaattgcggaaacaccttgtaagctgatgcggtatttggtcccagataatagtcacattgatccagatactccatttgctgaagttgaggttatgaagatgtgtatgcctttgctttcccctgcatctggtaaaatacaatttaagatgtccgaaggacaagccatgcaggttagcataggttttggaaaatctatatgttaactaattatactctaaaagttttttctaagtgcgtgttcgctgtgtaggctggcgagctcatagcaagacttgagttggatgatccttcagctgtaagaaaagctgaacctttccgtggcagttttccaattttgggccccccaactgctatctcaggaaaagttcatcaaagatgtgttgcaagtttgaatgcagcccagatgattcttgctggttatgaacacaacatagatgaagtaagtatttcaatagtgaattcaaaaaatcgagcaatatattatatacatgaagtattcctattatgaatttaacatagatgatgtaagtattcctctgaggggctgatgcaaaaatttgagatgtatatgtatgtctatttatattttggttggttcccttatcagaaagattctttacaaatgagttttctaattctcaggttgtccagagtttgctgatttgccttgatagtcctgaacttcctttcctgcaatggcaagaatgcttgtctgttctagcaacacggcttcccaaagatctgagaactgaagtatgctactaagttctgcatgcaattctttttctatatttgataaacacctgttgtctttagcagtctttatcttcttttttctttctttctttttctctgtaactcacattattttaccatgtttccttatctttggttttatcagttggagtcaaaatatggaaaattcgaaggagttaccaattctcagaacattgaatttcctgctaagctgtttaaaggtgttcttgaggtcagtctttctttttgttacccttctgtatatgatacagtttgagtgttacttacataagtattttgtttacaggctcatttgaattcatgccctgaaaaggagagaggagctcaagagcggctcattgaacctctaatgagtcttgttaaatcctatgaaggtgggagagagagtcatgcccatgttattgttcagtctctgtttgaagagtatttgactgttgaagaattgttcagtgacaatatccaggtttgttattgcagttgcaaattgatcagtttttttggtcaaccaatttgtaccgggacaaattgccacagtcctaatttattgatgatcatcggtcttcgtgtttttttcccggtttggttgattggttatcatgttatgaagttgtcacataaaaaaacctaaatttactaatgcacccatttgaccctagaggctacagagtctttggagtactctgtctctgtggatttatagtagcatcctttgaagtattactttattttttcaagaaattgtagttcatgtcttttgattctgatcttgaaaggaaggctgacatcattccactttattttctaatttcaatctatacaggctgatgtgattgaacgtctccgccttcaacataaaaaagacctgttaaaggttgttgacattgtcctatcacatcaggtaggcaggaaatttcaaataattcaaattaagtttgagttttcttttcccttttcccttgtaatatcttccaggcttgtttactatgtagtaataatggctttcagggtgttaagaacaaaaataaattgattctccggctcatggaacaactggtttacccaaatcctgccgcataccgggagaagcttatccgtttttcacaactaaaccatacaatctactctgaggttagtgattattcaattttttgtttatattgtcacactacagcattcacaaaaaggttattaagtttatacactaatcaattccttcactatatgcagttggcacttaaggcaagtcaattgcttgaacaaaccaagttgagtgaacttcgttctaatattgccagaaacctttccgagttagaaatgtttacagaagatggtgaaaacatggacactccaaaaaggaaaagtgctattaatgagcgtatggaggctcttgtgaatactccgcttgctgttgaagatgcccttgttggcttgttcgatcacagcgatcatacgttacaaaggcgggttgttgagacttatgtccggagactttatcaagtaatatctaagttccaacagtaaactttaactatcatttaataatgttatgtcatataactctattttttgtgggtaatctcttttctcagccttatcttgtaaaaggaagtgtcaggatgcagtggcacagatctggcctcattgtttcttgggagttcatggaggagcacattgaaagagcaaatgcctctaatgatctgtccatcaaccagccccttgttgagaaacacagtgagagaaaatggggagccatggtcatcataaaatctcttcagtttttgccaacagtgattactgctgcattaaaagagacaacacataattcagatgaaacgattcccagaggctctttagaatcaatcagtcatggaaatatgttgcacattgcacttgtgggtgttaataaccagatgagcttgttgcaggataggtatagattctatttttatggtttaagcaagattttaaaatgtgaacattggactatccaattttatttatgtttatttatttatttatttttttgacgaggactatccagtttttttgaagaaatatgctttgcttcaattatgcagtcgctctttatagtaaccattccggccttttgcttaacctttttttctctgtggggtttatgaaatggaattttatactatgcagtggtgatgaagatcaagctcaagagagaattgataagttggcaaaaatcctgagagagaaagaagtgagctcaggtcttcgtgacgttggtgtcagggtaattagttgcattatacagagagatgaaggaagaacgccaatgaggcattcattctattggtcagaagagaaacaatacttcaatgaagagcctttactacgtcatttggaacctcctctatcaatatatcttgaattggtatgatattctgagcaagaagctgtttcttgtttattattttcttgtttcttaatatgggtcaaatcattatctttaacatttttgtcactatttgatatagttataaggtatttggctcacaactttccttacacaggacaagctcaaggtctatgaaaatcccaaatatactccttctcgggatcgtcaatggcacctgtatactgtcatggacaagccatctattcgacgaatgtttttgaggacacttgtcagacagcccacttccgagttcagtggggttgaactaaaaattcttcaaacacaaaggcccatctcctttacttcaagaagcattctgaggtctttaacaactgcaatggaagaattagaactcaatgcgcacaatgctaccttgaaacctgatcatgctaatatgtacctgtacattgtaagagagcaacaaatacatgatcttgtcccatatcacaggttctaattactattcttaattttatgtgtctcatttgtggttattgatgcaacttatgctttaagagggattattttgatccgttaatccagggaggtgaacattgatgacgaacaagaagagacagctgttcatatgtacttggaagagcttgcgcttgaaatccacagttgtgctggtgtgagaatgcataaactaaatgtatgtgagtgggaagtaaaactttggatatcatcttctggtcaagccaatggttcatggagaatcattgttactaatgtgactggtcatacatgcactgtacatgtaagtttgaactatgataattttttcctataattttctgtaaaggtttttagtattggccgtgtttagtaatttctttcaacactcagatatttatgccagtttttgtaagaattacagaaatagtagcatgtttttagtgcccaagttctttctttgtccttttgcccagcaatatctttaataatttatgtataaactataagatattatgagactatacatcgagaaaaatctaaatacatcttccattacaacctttgatttttttttttttttttaaattgaaaaaacaatgggtaaaggtgatacatgaatcttgtaaaacacaaacaatgaccatacatatgggacggagggagtaataatggtttgtatattggcacttataaagaaaaaggttatgcacaattaatttatgtcttgtagacgtgtatcacataatgtcttctttagtttgctgacctttttctactaatgttatgcaggtttaccgtgagttggaggataacaaccttcatgaaatgatctaccattcagtatctgttcaaggtcctcttcatggaataccagtgaatgcaccctatcaaccacttggagtcattgctcgtaaaagactgcaggccatgaaaaacagcacaacctattgttatgatttcccactggtaagagatatcaaactccactgtaccacaatactacaaaagcagaatttacagtattaggtttcctttcctccaaaaaaatcaagggttgatgcatgacttacattcgagtgtaactatggttcttgtttacgctcaactagtaatgaaataggaatataaatctaataaagatttacaaattttggagagaggcggggttgtgtaactgtgggactttgtaaaggtttaaagttagttaggtggagatgcagggtttatatttagtttatgaggaaactacaagttttcaagattttaataggtaatacgtgtaaaattttaaaagatatcggaatatttgtcttagtattttggattattgtaactttgtaaataaaaatagtttcacattttgttaagatttcaagtttggctttcgcacacaatgggtctgttcttttcaccttatctgtacttatccgaacttttccgaacttctatgaacttgttttgtgagagagaaaaataataagtttgttcttttcaacttattttttattatctgaacttatttgaatttattttttctgaaattaagtaaaaataagctcaatagaacatacccaatgtagaaaaatagaattaaacaaagaaatagtggggaaaaaaagtggaggtgatttgtgtctcttgtgggcattagtttagtaacagctagagtaatggatatagatgacttatttttaattcattgtatgacatacatcaaaaacctgaaattttagtgatatcaaattggccttaattagtaatttagttgtttgatattgttggttatacaagtgaaaacagatacttaatatgcgaatgattgtgcctatagtgattatgtgactgtgttgttaaatataaaagtgtttcagtgtttttaagacaagggaagtagggaaccataaacaaaaatacgaagcatatcttgggtgttacctagttttgtcctatttctcaattattgatttagttgtttaatttgttggttataaaagagagaaaccgggattgttggtgtgcaaagattgtacctatagtgattatgtgacaacgttgtcaaatgtaaaagcattgcaatttttgtgaggcaaaggaaccataaataaaaatgcgaagcatggcttgggtgttacctagctttgtcctatttattgaactatgtgattgtacctcaaatttttatatttgatgttgtatcgatcaacttgctttagctcacgttagcatttatctgtttttctattggaaaattgacctgaaattattgggaatgtttttctcaggctttctctactgccttagagcaatcatgggcatctcaagctccgcttctgaagaaacccgctaacaaaaaagttttgaaagtctcagagctagtatttgctgattcaaatggcacctggggaacaccagttgtcccgacaaatcgtgaacctggtcttaacaatattggcatggttgcctggtccatggagatgtcaactcctgaattccctgatggaagaaccatattggttgtagcaaatgatatcaccttcatggctggatcatttgggccaaaagaagatgctctcttccaggcagttacagatcttgcttgttccaaaaaaattcctctgatttacctggctgctaattctggtgctcgactgggtgttgctgaagaggtaagagcatgctttaaaattggttggaccgatgagttgaaccctgagcgggggttccagtatatctacttgactcctgaagattatgagcgtatagggtcagcagttatagcccatgagttagaactccaaaatggagagactcggtgggttatagacactgttgtagggaaggaggatgggataggtgttgagaacttatctggaagtggagctatagctggtgcctactcaagggcatacaaagaaacttttactctaacttttgtaacaggaagaacagtaggtattggtgcctatcttgctcgccttgggatgcgttgtatccaaaggcttgatcagcccattattctgacaggcttttctacgttaaataaacttcttggtcgtgaggtttacagctcacaaatgcaacttggcgggcccaagattatgggtacaaatggtgttgttcatttaacagtttcagatgaccttgaaggcatttcagctattgtcaagtggctcagctatgttccatcctactcaggaggtgaacttcctatttcacgttctttagatcctcctgaaagacaggttgattatttgcctgaaaattcttgtgatccccgttctgctatatctggtacacttgactctaatggcaattggcttggtggaatttttgacaaagatagttttgttgaaaccctagaaggctgggcaaggacagttatcactggccgggccaaacttggtggaatcccagttgggatagttgctgttgagacacaaactgtgatgcaagttatcccagcagatcctggtcagcttgattcgcatgagcgagtggtcccacaagctggacaagtatggtttccagattctgcaactaagacagcacaagctttgatggattttaacagggaagaacttccacttttcattctagctaactggagaggcttctctggagggcaaagggatctctttgaagggattcttcaggcagggtccacaattgtcgagaaccttaggacttataatcaacctgtttttgtttatatccccatgatgggtgaacttcgtggtggggcatgggttgtcgtagacagtaaaatcaattcggaccatattgagatgtatgctgatcagacagctaaaggaaatgttcttgagccagaaggaacgattgagatcaagtttagaaacaaggaattaattgaatgtatggaaaggcttgatcaacatctcatcaatcttaacgcaaaactcgtcgaagccaaaaactccaatttatatgttaatatcgaactcctgaaacagcagatagaagctcggcagaagcaacttttgcctctatatactcaaatagccacaaaatttgctgaattgcatgatagtccttatagaatggctgcgaaaggagtcgtcaaggaagtcctggattggagcaattctcgcttattcttccacaaaagactgtacaggagagttatggaggaatcacttgtcaagaccgtccgagatgctgctggtgaagcaatgacccacaagtctgccatggaattgatcaagcaatggtttgctcagtctgatagtactagtggagtgggagctgatccttggtctgatgatgaagctttcttcaagtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtatctctaaggttcctccacacacacacacaccccacccaccaaaaaaaacacacaacacaacagtgag

SEQ ID NO: 79 - DNA, 8717 bp, Kochia scoparia
gatcttgattgatgttgaggatgacttgttctgacgttgttttcttgatgatcggcctgtaaaatgaaacaaagattgctacctcggaggttttcccgagtaaaacctctccgaagtttaagtcagttcaatgatcttgaatggattggtattttaggaatttaatgtgagtcgttttagaattagatacctgattttgtgtggagagcttggtatatataggcaatcgggtgacctactagcttatcagtcaagcgatgtaatccggcacctggtagcttgtcatcagtttgactgggcaattaatggtcaagcggtttgaaatgtgtttcttggaccttaaatatggctttggttataatgagctagatttaggtttggaccttagttttatgggttaatactagaggcgatcaaaaaaacccggcccgacccaaaattttgtgggctttggtcacgacttttttttggcccgaatacccatacacaaactaaaatggctagtacaaaagtacaaatatacaaaagttgttcttactagaaaaagctagttattgaccatcaattatctcaagtccaaataaacttttataagcactagaagtaagttgtatgagaagtattgatcaataactcagcaaaatagtacttcgtatataattataaacaagaagtcaaatttggtggagtgtgattgaattgaaaaaattggtagaattcaatatgatacaacaaagaaaagctacatggtcatattaaaagttaaattttgcataacaagagtaaaagaaatgataaattgattgacacgatcaataaatcaccggataaattcgtcatttcttattatcagtccttcaaattataataaattccccaatcccccacctaccattatactcgtaagtttttaacaatgctggaacaaacagtgcaaatgtgtgatttaaaaatcggtgctatttgtttatacttcctcgttgcagtagcatcatcacacattcatactaaaatcaaaatcacattcatcataaatcataataataaataatagaataattatacaggtagctgaaaggtgggcagttgccacgtgcatccccaaataaatatgcagttaattgaatgagatggaatggaaggcattctctgcacctcaaaccaaaccaacccccttcttcccctctaacacttcttcaatgacttctcttccttcttcttattctcattatatatacattcacaagtagctgatcactactgttttcttttttttgttctgtctaaagtttgattcttttccatcaaagtttgcttttttatgcaataattcaaattgcccagatgctaatttagtggaatttcattgaaaggtttgtttttttctgctgaattatgtccctttgatttgatttgagtgttttttaagtttatgatgaatcatacatgcccttttatttgagttgattttgggatttgtcttatgttggggttggtttttggttggtttttggttggttttttttggtagtgtgtagttgagctaattaagtgtagaatagtgtgaaataatatattggttgtattgggtattgcttactagaaaatgtgattcattttggtagttagttggctttagttgactgactcttctaagttctaactatgattgattgattgataatacaggtatgtgtagtccaaattggacctcattttataattatcctcattttataattataatttgttttttttggcattggattgttgactcttgaattctacttcactacttgaattgcattggattttttctattagtatttagcttttatgccataataaaaacttctgcctttcattcagctggtatgttctatacttctattctttttttttttttatataaattaattctttctttctctgttaatgttgttgttgtgttggataatatgttaattacccaattaaagagctcaaatcttgaagtaatgtatgagtattgcttatgatagtagcttttgtgattcaaagcttgcatcattcattaattgactatttgttttgtgtaatacgaggttgttgtagcttgattgctttttgacaggtagaatatgcttatcatgtgaaaattgggaatgttattcatgtgatttgatgttattaggatgctgaccagtgttttatgaggtgatactgattcaacttgttgatgtaacagttataggaaaatcgggcgtattttttgctgagggcggggcggtgtgttaactagggaagagccaaagatggcaactctagtgcgaaacattgattaccttaatggaacaactctgttgaggaattctactacattacccgttgttgatgaattttgttatgctcttggagggaaaaagccgattcatagtattttgattgccaacaatggaatggcagctgttaaatttatcagaagtgttcggacatgggcttacgaaacttttggaacagagaaggctattgtattagtagcaatggctactccagaagacatgagaatcaacgctgaacacattcgaatggctgaccagtttgttgaggttcctggtgggactaacaacaacaactatgccaatgtacagctcattgttgaggtaaatcctgctttagtaacactgatcttccgtgttttctctgttagattacgaaatactcacattagccacagtgtatgagaaaagatatcacctgtcctgttggcctgttgatgttcatcattgatttcagaggataaaattttgttaaaaagacttcaatttattttcactgctctttcagatggcagaaattacacgcgtagatgcagtttggccaggttggggacatgcatctgagatccctgagcttccagatgcactaaccgcaaaggggattgaatttctagggcctccagctatatctatggctgctcttggagacaaaatcggttcatcattgattgctcaggccgcagatgttccaactcttccatggagtggctctcatgtatgaattgattttcttatcgaccttcacaaactttctttttctcaaggagtttcctaatcagttttcttaaatttctatgctttaggtgaaagttcctgctgagagttgccttgatactattcctgatgatatatacaaggcagcctgtgtttttaccacagaggaagcaattgctagttgtcaggttgtcggttatccagctatgattaaagcatcttggggtggtggtgggaaaggaataagaaaggtgagctagttgtttgggataatgtggtcaagaaattaaagcaccatcttcatatatatctctattgcttatttatcaacattttcacagcttccatccttgaacatcctttaattagtcaattgtctataattatctactagtcttaaatgatggacaaatgcttcaaacttgttagttagctagagacctgttaatctgttatgctacttcaatttcaatcgttttcctttcaaaatatcagaaagactcaatagttatgcatttttaggtacataatgatgatgaagtaagggcattgttcaagcaagtgcagggcgaagttcctggctcacccatatttataatgaaggtggcttcacaggttagatattctgcaaattggttctataatgaattatataagcactcagaagttcacggcactcgtgatcttagaacttgtactatatgcaaaattctttgttttgacaagttgttatatgtgcttcattcagagtcgacacttggaagtacatctactttgtgatcaatatggcaatgtagcagctttgcatagccgtgattgcagtgtccaaaggcggcaccagaaggtgggtccctagtgtactatcaataaacttttaatcttcttgaccaatttagtattacttcgggtctaaagtatattttttcaaagaaaatcgttatgtctcattgtttttgaaggaatgtataaatattttgtccattgtattaattgatcagattattgaagagggtccaataactgtagctccaccagaaactgtgagaaaacttgagcaggcagctagaaggttagccaaatgtgtgaattatgttggagcagcaactgtagaatatctgttcagcatggaaactggcgagttttatttccttgagctaaaccctcggctacaggtttgaagaatacacttgcacattgtatattcgtattttccttaagaaaaatattttatgttgatatttatggtattgcaactcaatatcctctagatatatcgttttctaccgtacgtttgtggctcactttattatgacatgctttgttaaaaagccttgggatttcttagagtgagacatgtcacccttgcttttcaacttctgtgaatcatgtcttatactccctccatttccttttgtttgtctgatttaaatcttgggtgttgacactattcataggtagagagattcctctaaatttataagataaaacttagctctgtggggccttgtttaattcattttgatgagtactttaatgatattaaatttttagaatttatattcatatatagttaaagatttgttaaatgtttgctgcgacaaacatgtgataatgaaatgggtcagaagaatggaatggagggagtactgctaagaattatcaatcctatatgatcatatgatggatgaaaaaaaaaattcttatttgacttttctgacaatattgtatataatgtccatatgtgcaggttttattttaaaaaatttccagtattggaaatccagttaattttattggttatttatttaattccttcttttttcgcatttgatatatacaggtggagcatccagtaactgaatggattgctgaaattaaccttccagctgctcaggttgcagttggcatgggtattcctctttggcaaattccaggtagcttgcatgttccctttttttattatataacttatgtgcttcatcttgttcttgtgtatgagttggcttgcttttgcaatttcaaaatagaaattcggcgattctatggtaaggaacatggtggcggttatgatgcttggagaagaacatcagttgcagcgactccttttgattttgacaaggcacaatctgtgaaaccaaaaggtcactgtactgccgtacgtgtgacaagtgaggaccctgatgatggattcaagcccactagtgggaaagtacaggttaataatgctattgttttatagttcaaactattttctcaattgattgccttgtctgttttgtgattcatgtaaaattatttaattcattggtttcttttctaggagttgagtttcaaaagtaaaccaaatgtgtgggcctatttctctgttaaggtatgtctttattttttttaagctttacatcatcctttatggactcattcacgagcttaacaatggtcaacactgtcaattgcagtctgggggaggcattcatgaattctcagattctcaatttggtaagtttaaagcacattttaaagatgactagcaatgaaatgactattatagctgccttttaagaatgaagttcttcaacatcatagtattcattctctaatttaagactgctgcaaatggattgagaactgtgctgttgtgcatgtgaaatgagatatattggtttttcatagtgtgtcattgtagacagtaaatgctcttgttaattgttgatgattggaattgggatttagcatgcttggtgtagttttctcttgcacaaacaagtctcacggagttgatgtgtcatgtttttgtcgattatttttggtttaaaacatcaaattttgttttcttttatttatagaaggctaatgttaattaatttgtttgtagggcatgtctttgcatttggtgaatcaagagggttggccatagcaaacatggttcatggcttaaaagaaattcaaattcatggagaaattcgcacgaatgttgattataccattgattttttaaaagtaaaccttatacattttaactttgtagattttaattgagcatgtggccttatccttttacataccctttccggctgattgaggaataggagtttcccgctataaccaatgcacacaatgatttcaaaatacaaggataaggattttgctgtaaaatgaaggttgtgcctttcatttatttttatttgttgatgcattgtgctgtaaaattaaggccttcattttcatttattttattattttaaattggaggtataccaccttcttctaattgaattttgcaattgttgcatgattttgcaattgttgcatgattatgctctacttttaaagattgaattttgcaatttgttgtgtgtggtgtatgtcaatcaattatataaagtagaatgctagagtgaaaataaatggtcagcagcactatagcagaaaaaaaaaacaaatataaggtgtcatataacacactcattaactcaggactacaactttaccccaacttgttatcgatattacccatttgctacatctcatatgttcttacaattttttttattcgtcaaatttgtaagacaagaggccttgattgtgaatttcctgtcaataccctctcaattctaaaaaaaatatcatgactactagactatgagagttttgttagatcttatcaagcataaaggattctattaaaaaaataaaattatactagcagttgctaccattggaatgttaatgtttatctttcttggagggttagtaataactttaatcaatgagagtgacccacaaagctttcatgattctttatataaatgattattgttcccgctgtaaaattgttcccgttgtctcatttaattgtttaaaatggataagatttgattagttttactgttaatgatgtttgtgtttgattagttttagtattttgcttaattgttgagattaattgttgaattaatgtgggtgatgaactgtgcaaggaagtgcagtagcagcagctatgagaaatcagctacagtaggtccaaggaatgtaacagcagctgcaactgacctgggggcctgtgcaagctgttcaggttgtctggacttgtgcaggcatccccggggcttgtgtaggcaaggcagcagcaagtgcaacagcatcaggtcttgtaggacagtgtcgacaccgtttcggtacatgtaatttggctgttcaattgaatattatttggcatgaagaagatcatgagttacatgattatagaaaatgattgtcttccagtggagctaatcaaggtcctcctagatagcctcaagaaggaaaatgatgtatctcttgctttattgctttccgaatttcccatcttttactcggttgttgtgttttttgcccttataatcatgcccgtctcagaaaaactcacctgcagcttttaatttgggtgtctttggcatgctcattctttttttttcaaccgatttcaaattttttgatttatttactgtgttttattgcaacttgagtgatttgtatttacttatgattgttatagaatttttgttatggtttggtttttggcttatttattagcttgggtctgaaatttgatctttcatatggtcgggtttatgagttaattagggcgttttactttctagtaattattgagatgatttattttaaaagaattagtttgactatatggaagaagttttagttgtgaatgtaatatttgtttttttacaaatactttaaatttgcaattttacggttgtgtttaagaagagcagaaacagaagaaggaagtgggaaatcatagaccacttcaagagattggctattttgatttttgaatgagattttatggtgctattgttgctggttgattgttagaggatccttgcatttgagcgaaaacaaagcaatccaagtgtaaactcatgctaatttcatggtttaaagtttttcattgttgattttagatttcttagtcttagatatttgtttttggtattcattttttaggggaaggaatgtttatattcaattttcatcacatcaagaattaactatgatggagcagagcacacatgggcgagcagatgaggttggtttttatcattgataattgaatgcaactaacaggggcaaactaagtactcaactaactaattaggcaaagttacctatacgactataattggacccaattaaggttactagcttgctgcaattttaccagtttgctaagcaaaatattacatattgtatatatagttagaatttgtccttttgttcgaggaaagaaaaagtaagggatgaaaatttgagactttctattagcaatttcatttaaattccaaaaaaagggtctcatctattttttttataacttgttgctataaaatttgcaatgtgattgattgattgttaatatgaatttgtaatatgttttaacaggattcctgtgtcatctgtggctcaaaggtacttgacattaagatcacagtaagttcatccaattattataattatcttatcacttttgatattttaattgtttctcaaggattattgagaaagtttcaattcatttaggccctttttagttaacaataggctaattctactgcctcttgttttaggttgcctcataggcactcttacttctgaaaataaacctcaaataaccatgatcgacct

SEQ ID NO: 80 - DNA, 6978 bp, Kochia scoparia
cagtctctgtttgaagagtatttgactgttgaagaattgttcagtgacaatatccaggtttgttattgcagttgcaaattcatcagtttttttggtcaaccaatttgtaccgggacaaattgccacagtcctaatttattgatgatcatcggtcttcgtgttttttttcccggtttggttgattggttatcatgttatgaagttgtcacataaaaaaaacctaaatttactaatgcacccatttgaccctagaggctacagagtctttggagtactctgtctctgtggattatagtagcatcctttgaagtattactttattttttcaagaaattgtagttcatgtcttttgattctgatcttgaaaggaaggctgacatcattccactttattttctaatttcaatctatacaggctgatgtgattgaacgtctccgccttcaacataaaaaagacctgttaaaggttgttgacattgtcctatcacatcaggtaggcaggaaatttcaaataattcaaattaagtttgagttttcttttcccttttcccttgtaatatcttccaggcttgtttactatgtagtaataatggctttcagggtgttaagaacaaaaataaattgattctccggctcatggaacaactggtttacccaaatcctgccgcataccgggagaagcttatccgtttttcacaactaaaccatacaatctactctgaggttagtgattattcaattttttgtttatattgtcacactacagcattcacaaaaaggttattaagtttatacactaatcaattccttcactatatgcagttggcacttaaggcaagtcaattgcttgaacaaaccaagttgagtgaacttcgttctaatattgccagaaacctttccgagttagaaatgtttacagaagatggtgaaaacatggacactccaaaaaggaaaagtgctattaatgagcgtatggaggctcttgtgaatactccgcttgctgttgaagatgcccttgttggcttgttcgatcacagcgatcatacgttacaaaggcgggttgttgagacttatgtccggagactttatcaagtaatatctaagttccaacagtaaactttaactatcatttaataatgttatgtcatataactctattttttgtgggtaatctcttttctcagccttatcttgtaaaaggaagtgtcaggatgcagtggcacagatctggcctcattgtttcttgggagttcatggaggagcacattgaaagagcaaatgcctctaatgatctgtccatcaaccagccccttgttgagaaacacagtgagagaaaatggggagccatggtcatcataaaatctcttcagtttttgccaacagtgattactgctgcattaaaagagacaacacataattcagatgaaacgattcccagaggctctttagaatcaatcagtcatggaaatatgttgcacattgcacttgtgggtgttaataaccagatgagcttgttgcaggataggtatagattctatttttatggtttaagcaagattttaaaatgtgaacattggactatccaattttatttatgtttatttatttatttatttttttgacgaggactatccagtttttttgaagaaatatgctttgcttcaattatgcagtcgctctttatagtaaccattccggccttttgcttaacctttttttctctgtggggtttatgaaatggaattttatactatgcagtggtgatgaagatcaagctcaagagagaattgataagttggcaaaaatcctgagagagaaagaagtgagctcaggtcttcgtgacgttggtgtcagggtaattagttgcattatacagagagatgaaggaagaacgccaatgaggcattcattctattggtcagaagagaaacaatacttcaatgaagagcctttactacgtcatttggaacctcctctatcaatatatcttgaattggtatgatattctgagcaagaagctgttgtttttcttgtttattattttcttgtttcttaatatgggtcaaatcattatctttaacatttttgtcactatttgatatagttataaggtatttggctcacaactttccttacacaggacaagctcaaggtctatgaaaatcccaaatatactccttctcgggatcgtcaatggcacctgtatactgtcatggacaagccatctattcgacgaatgtttttgaggacacttgtcagacagcccacttccgagttcagtggggttgaactaaaaattcttcaaacacaaaggcccatctcctttacttcaagaagcattctgaggtctttaacaactgcaatggaagaattagaactcaatgcgcacaatgctaccttgaaacctgatcatgctaatatgtacctgtacattgtaagagagcaacaaatacatgatcttgtcccatatcacaggttctaattactattcttaattttatgtgtctcatttgtggttattgatgcaacttatgctttaagagggattattttgatccgttaatccagggaggtgaacattgatgacgaacaagaagagacagctgttcatatgtacttggaagagcttgcgcttgaaatccacagttgtgctggtgtgagaatgcataaactaaatgtatgtgagtgggaagtaaaactttggatatcatcttctggtcaagccaatggttcatggagaatcattgttactaatgtgactggtcatacatgcactgtacatgtaagtttgaactatgatgattttttcctataattttctgtaaaggtttttagtattggccgtgtttagtaatttctttcaacactcagatatttatgccagtttttgtaagaattacagaaatagtagcatgtttttagtgcccaagttctttctttgtccttttgcccagcaatatctttaataatttatggttataaactataagatattatgagactatacatcgagaaaaatctaaatacatcttccattacaacctttgattttttttttttttttttttaaattgaaaaaacaatgggtaaaggtgatacatgaatcttgtaaaacacaaacaatgaccatacatatgggacggagggagtaataatggtttgtatattggcacttataaagaaaaaggttatgcacgattaatttatgtcttgtagacgtgtatcacataatgtcttctttagtttgctgacctttttctactaatgttatgcaggtttaccgtgagttggaggataacaaccttcatgaaatgatctaccattcagtatctgttcaaggtcctcttcatggaataccagtgaatgcaccctatcaaccacttggagtcattgctcgtaaaagactgcaggccatgaaaaacagcacaacctattgttatgatttcccactggtaagagatatcaaactccactgtaccacaatactacaaaagcagaatttacagtattaggtttcctttcctccaaaaaaatcaagggttgatgcatgacttacattcgagtgtaactatggttcttgtttacgctcaactagtaatgaaataggaatataaatctaataaagatttacaaattttggagagaggcggggttgtgtaactgtgggactttgtaaaggtttaaagttagttaggtggagatgcagggtttatatttagtttatgaggaaactacaagtttacaagattttaataggtaatacgtgtaaaattttaaaagatatcggaaaagttgctagaataaaggaagtttagctaactttaaagaatatttgtcttagtattttggattattgtaactttgtaaataaaaatagtttcacattttgttaagatttcaagtttggctttcgcacacaatgggtctgttcttttcaccttatctgtacttatccgaacttttccgaacttctatgaacttgttttgtgagagagaaaaataataagtttgttcttttcaacttattttttattatctgaacttatttgaatttattttttctgaaattaagtaaaaataagctcaatagaacatacccaatgtagaaaaatagaattaaacaaagaaatagtggggaaaaaaagtggaggtgatttgtgtctcttgtgggcattagtttagtaacaactagagtaatggatatagatgacttatttttaattcattgtatgacatacatcaaaaacctgaaattttagtgatatcaaattggccttaattagtaatttagttgtttgatattgttggttatacaagtgaaaacagatacttaatatgcgaatgattgtgcctatagtgattatgtgactgtgttgttaaatataaaagtgtttcagtgtttttaagacaagggaagtagggaaccataaacaaaaatacgaagcatatcttgggtgttacctagttttgtcctatttctcaattattgatttagttgtttaatttgttggttataaaagagaaaaaccgggattgttggtgtgcaaagattgtacctatagtgattatgtgacaacgttgtcaaatgtaaaagcattgcaatttttgtgaggcaaaggaaccataaataaaaatgcgaaacatggcttgggtgttacctagctttgtcctatttattgaactatgtgattgtacctcaaatttttatatttgatgttgtatcgatcaacttgctttagctcacgttagcatttatctgtttttctattggaaaattgacctgaaattattgggaatgtttttctcaggctttctctactgccttagagcaatcatgggcatctcaagctccgcttctgaagaaacccgttaacaaaaaagttttgaaagtctcagagctagtatttgctgattcaaatggcacctggggaacaccagttgtcccgacaaatcgtgaacctggtcttaacaatattggcatggttgcctggtccatggagatgtcaactcctgaattccctgatggaagaaccatattggttgtagcaaatgatatcaccttcatggctggatcatttgggccaaaagaagatgctctcttccaggcagttacagatcttgcttgttccaaaaaaattcctctgatttacctggctgctaattctggtgctcgactgggtgttgctgaagaggtaagagcatgctttaaaattggttggaccgatgagttgaaccctgagcgggggttccagtatatctacttgactcctgaagattatgagcgtatagggtcagcagttatagcccatgagttagaactccaaaatggagagactcggtgggttatagacactgttgtagggaaggaggatgggataggtgttgagaacttatctggaagtggagctatagctggtgcctactcaagggcatacaaagaaacttttactctaacttttgtaacaggaagaacagtaggtattggtgcctatcttgctcgccttgggatgcgttgtatccaaaggcttgatcagcccattattctgacaggcttttctacgttaaataaacttcttggtcgtgaggtttacagctcacaaatgcaacttggcgggcccaagattatgggtacaaatggtgttgttcatttaacagtttcagatgaccttgaaggcatttcagctattgtcaagtggctcagctatgttccatcctactcaggaggtgaacttcctatttcacgttctttagatcctcctgaaagacaggttgattatttgcctgaaaattcttgtgatccccgttctgctatatctggtacacttgactctaatggcaattggcttggtggaatttttgacaaagatagttttgttgaaaccctagaaggctgggcaaggacagttatcactggccgggccaaacttggtggaatcccagttgggatagttgctgttgagacacaaactgtgatgcaagttatcccagcagatcctggtcagcttgattcgcatgagcgagtggtcccacaagctggacaagtatggtttccagattctgcaactaagacagcacaagctttgatggattttaacagggaagaacttccacttttcattctagctaactggagaggcttctctggagggcaaagggatctctttgaagggattcttcaggcagggtccacaattgtcgagaaccttaggacttataatcaacctgtttttgtttatatccccatgatgggtgaacttcgtggtggggcatgggttgtcgtagacagtaaaatcaattcggaccatattgagatgtatgctgatcagacagctaaaggaaatgttcttgagccagaaggaacgattgagatcaagtttagaaacaaggaattaattgaatgtatggaaaggcttgatcaacatctcatcaatcttaacgcaaaactcgtcgaagccaaaaactccaatttatatgttaatatcgaactcctgaaacagcagatagaagctcggcagaagcaacttttgcctctatatactcaaatagccacaaaatttgctgaattgcatgatagtccttatagaatggctgcgaaaggagtcgtcaaggaagtcctggattggagcaattctcgcttattcttccacaaaagactgtacaggagagttatggaggaatcacttgtcaagaccgtccgagatgctgctggtgaagcaatgacccacaagtctgccatggaattgatcaagcaatggtttgctgagtctgatagtactagtggagtgggagctgatccttggtctgatgatgaagctttcttcaagtggaaagaaaatcctgctaattatgaagaaaagctaatcgagttgcgcatacagaaggtattgcatcagctgtcaaatattggcaactcggcttctgatctgagagctcttcctcggggtcttgctgcccttctccagaaggtatctctaagtc

SEQ ID NO: 81 - DNA, 4017 bp, Kochia scoparia
ttcttttcaacttattttttattatctgaacttatttgaatttattttttctgaaattaagtaaaaataagctcaatagaacatacccaatgtagaaaaatagaattaaacaaagaaatagtggggaaaaaaagtggaggtgatttgtgtctcttgtgggcattagtttagtaacagctagagtaatggatatagatgacttatttttaattcattgtatgacatacatcaaaaacctgaaattttagtgatatcaaattggccttaattagtaatttagttgtttgatattgttggttatacaagtgaaaacagatacttaatatgcgaatgattgtgcctatagtgattatgtgactgtgttgttaaatataaaagtgtttcagtgtttttaagacaagggaagtagggaaccataaacaaaaatacgaagcatatcttgggtgttacctagttttgtcctatttctcaattattgatttagttgtttaatttgttggttataaaagagagaaaccgggattgttggtgtgcaaagattgtacctatagtgattatgtgacaacgttgtcaaatgtaaaagcattgcaatttttgtgaggcaaaggaaccataaataaaaatgcgaagcatggcttgggtgttacctagctttgtcctatttattgaactatgtgattgtacctcaaatttttatatttgatgttgtatcgatcaacttgctttagctcacgttagcatttatctgtttttctattggaaaattgacctgaaattattgggaatgtttttctcaggctttctctactgccttagagcaatcatgggcatctcaagctccgcttctgaagaaacccgctaacaaaaaagttttgaaagtctcagagctagtatttgctgattcaaatggcacctggggaacaccagttgtcccgacaaatcgtgaacctggtcttaacaatattggcatggttgcctggtccatggagatgtcaactcctgaattccctgatggaagaaccatattggttgtagcaaatgatatcaccttcatggctggatcatttgggccaaaagaagatgctctcttccaggcagttacagatcttgcttgttccaaaaaaattcctctgatttacctggctgctaattctggtgctcgactgggtgttgctgaagaggtaagagcatgctttaaaattggttggaccgatgagttgaaccctgagcgggggttccagtatatctacttgactcctgaagattatgagcgtatagggtcagcagttatagcccatgagttagaactccaaaatggagagactcggtgggttatagacactgttgtagggaaggaggatgggataggtgttgagaacttatctggaagtggagctatagctggtgcctactcaagggcatacaaagaaacttttactctaacttttgtaacaggaagaacagtaggtattggtgcctatcttgctcgccttgggatgcgttgtatccaaaggcttgatcagcccattattctgacaggcttttctacgttaaataaacttcttggtcgtgaggtttacagctcacaaatgcaacttggcgggcccaagattatgggtacaaatggtgttgttcatttaacagtttcagatgaccttgaaggcatttcagctattgtcaagtggctcagctatgttccatcctactcaggaggtgaacttcctatttcacgttctttagatcctcctgaaagacaggttgattatttgcctgaaaattcttgtgatccccgttctgctatatctggtacacttgactctaatggcaattggcttggtggaatttttgacaaagatagttttgttgaaaccctagaaggctgggcaaggacagttatcactggccgggccaaacttggtggaatcccagttgggatagttgctgttgagacacaaactgtgatgcaagttatcccagcagatcctggtcagcttgattcgcatgagcgagtggtcccacaagctggacaagtatggtttccagattctgcaactaagacagcacaagctttgatggattttaacagggaagaacttccacttttcattctagctaactggagaggcttctctggagggcaaagggatctctttgaagggattcttcaggcagggtccacaattgtcgagaaccttaggacttataatcaacctgtttttgtttatatccccatgatgggtgaacttcgtggtggggcatgggttgtcgtagacagtaaaatcaattcggaccatattgagatgtatgctgatcagacagctaaaggaaatgttcttgagccagaaggaacgattgagatcaagtttagaaacaaggaattaattgaatgtatggaaaggcttgatcaacatctcatcaatcttaacgcaaaactcgtcgaagccaaaaactccaatttatatgttaatatcgaactcctgaaacagcagatagaagctcggcagaagcaacttttgcctctatatactcaaatagccacaaaatttgctgaattgcatgatagtccttatagaatggctgcgaaaggagtcgtcaaggaagtcctggattggagcaattctcgcttattcttccacaaaagactgtacaggagagttatggaggaatcacttgtcaagaccgtccgagatgctgctggtgaagcaatgacccacaagtctgccatggaattgatcaagcaatggcttgctgagtctgccatggatagtactactagagcgggagctgatgcttgggctgacgatgaagctttcttcaggtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtatctctaaggttcctccacacacacacacaccccacccaccaaaaaaaacacacacacacacattcacaagaaaagtagaattgctagtgaaataacttcatcgtgttcaatgcaggtgaattcctcaagccgagcaaatctagtagagaaactcgagaaagtgctcaattgatttggtaatgatcctgcagaaaaacctcttggtatatggtggtatgcaaatgccatatctgaaagattgattaggcaagttgagacagagacaggcacagttgtaataatgggatctatcaaaccagaagacgttataactaagctcaaagatgatggtgattttgaccgtcttcgtctcaaaatcattcgtaagctcaaacaaaacgtatttctttctccttttcatcttctactgtatattaaatggtttaaaatttgatcttgattaatgggtaatctttataattttatcttttttattataatacaagaatgatatgcatatttttattttgttattaattaccaaatgcacttcagtttacattgccggttttgaagttttggaagcagaattggggttagaatgctagatattattgcttgttgatcatttattcagttacttacattgtttggttgaaatcggaattaaaagagcacaaattgtatggtttctaactcgacttcacaataagagtatagatgctcactgttgtgttgtgtgttttgtttttgttaagaaatattggttttgattgatgatgctccaagcctcgagtgagcgtgttgatgaaatagagtactgaattaaaggttatcattttatcgaatgtcagattaattgttaattgttgctcggagtcggagtttaaatgagaatcattttatcgaatgtcttaagttatcagggcagatattttttttctagtgggtatggactcttgagcctcttttttctgtatcaaactgtcctgttggttgttcaaattatgcaaatcatgaagagattactttggtctcaggtttgcttcgccatccttcccaatgaatc

SEQ ID NO: 82 - DNA, 2591 bp, Kochia scoparia
acaatgaggcctggtattttataaaaaagaaaagaattgttagtgctaaaaactcctcgtatacaaagttacaaacaacacccagcatccattttgcatatctaacacaaaatatacaaaacatattaggcaggacaaccaagaattcagagggaaatcttaaaatatgttaatgcgggcagtacgattccactgcgaaaaatttactcacttagaccaaggttaggaacaacaatgtacacgaatgttgagcagagaaaatatatacaaatgaagcagttcatatacaataaaaggcagagaagatgcccaatattcccctttcaatcgaaattcacaattgatcttgtcattagaaaagtgaaacaagagggtctcatcgtaattaagggaatgaagtatgcttcagccatacccaacagtaccttacaataactgtcaagtttcctcactatcttgagctgcccaagatggtgcagcaagcacttgcgctgctagtctcagaaaaacaactataggcaatcccatcaagatcttgttttcttccaggaattaaaatagttcagtttcatcaacatccaaacatcaaaaacaaaatgacctgagatagaaaagagcacttacaagcaccttttgatgtgcaacaaaagaacaatttcctcagacgaagcactctttctcttacccaaaataggctacacactcattcagatctcagggttgctacactcatatcgatcccagaaatctttcgtttttagggagcagatttcctcgcaaatgagcatgtaagtactagtttgaaattatctacactacaacttgacatcaatatcagactctgacagccagggccaaagccatcggatttggttactcatctgctcacacaaattgaaatgtccgggacatagaagaaaaaaatacacctatgatggtcttgcgaaaaactattaaataaagtactatatttatcttcttattagaccattttagatcagagaatgttgcttaaaatatcctaaggaaaaagctcaggctatatgattgtattacaccatattattgatatcccagagtgcactaagggactggtgaatttggtgttaagcagatgttatcaatcccaactacatcatatcccatctactaggcaggcagcggcaaggcaataatgttagggaaaaaaatcccattatctccattagaaaactatcatattagtctttaaaatttaaacaaaaaggaatttcaaaacaaaatgttgatttcaataggctatgtaacctaagcaatgttaacaagcagaatgctggtttcactagaagagctagtgggctacaggctacaaattatctaagccattcttgtttcctatgattagttttaataggcataatagcataaattcttctatacacatctgccggcatttactgcatcactacattacccgttgttgatgaattttttttatgctcttggagggaaaaggtcaattcatagtatttggattgcaaacaatggaatgacaactgttaaatttatcagaagtgttcggacatgggcttatgaaaattttggaacagagaaggctattgtattagtagcaatggctactccagaagacatgagaatcaatgttgaacacattcgaattgctcaccagtttgttgaggttcctggtgggactaacaacaactatgccaatgtacaactcattgttgaggtaaatcctgctttagtaacactgatcttccgtgtttttgcactaatgttgattataccatttatcttttaaacgtaagccttatacatgaattttccccctacactgttcactgttttttcaattagaacctaaatttgtctttgtttttccctttctctagtctttggattacaaagataataaaattcatacgggttggttagatagtagaattgcaatgagagtcagagcggaaaggcccccctggttcatctctgtggggggaggtgcactctacgtgtgtacaacttttctcttaaatttttttccttccaaaagcttgatgtgtcactttcgtttatttttataatgaataattttaaatacttcgtaatttctttctcctttctccctatcttcagtaagcttcttctagtagtgcagctactgtttcagaatatattggctatcttgagaaaggtcaaattcctccaaaggtaatccaaacaccagatgctgttgagatataattgttttttaaacactaattgtttctttcagtaaattacatcaatatttgtgtggattgcagcatatttcacttgtccacttggaagttactttgaatattgaggggagcaagtacactataagtttattattaagttatgtgaatttcatttttcgttcatggtttctcctgtttacttgatgttaatcatcataacatggttgattctgttctccagatcaaaatggtgagaggcggtccaggaagctacagattgtgattgaatgagtcaaagattgaggcagaaatacatacattaagtcattaagagatgggggtcttttaatgcaagtaagaacttaattttta

SEQ ID NO: 83 - DNA, 704 bp, Kochia scoparia
gtgttcggacatgggcttatgaaaattttggaacagagaaggctattgtattagtagcaatggctactccagaagacatgagaatcaacgctgaacacattcgaattgctgacgagtttgttgaggttcctggtgggactaacaacaactatgccaatgtacaactcattgttgaggtaaatcctgctttagtaaaactgatcttccgtgtttttgcactaatgttgattataccattgatcttttaaacgtgagccttatacatgaattttccccctacattgttcactgttttttcaattagaagctaaatttgtctttgtttttcctttctccagtctttggattacagagataataaaattcatacgggttggttagatagtagaattgcaatgagagtcagagcggaaaggcccccctggttcatctctgtggggggaggtgcactctacgtgtgtacaacttttctcttaaatttttttccttccaaaagcttgatgtgtcactttcgtttatttttataatgaataattttaaatgatttctttctcctttctccctatcttcagaaagcttcttctagtagtgcagctactgtttcagaatatattggctatcttgagaaaggtcaaattcctccaaaggtaatccaaacaccagatgctgttgagatataattgttttttaaacactaattgttt

SEQ ID NO: 84 - DNA, 842 bp, Lolium multiflorum
gacatgaggataaatgcagagcacattagaattgctgatcagtttgttgaagtacctggtggaacaaacaataacaactatgcaaatgtccaactcatagtggagatagcagagagaacaggtgtttcggccgtttggcctggttggggccatgcatctgagaatcctgaacttccagatgcactcactgcaaaaggaattgtttttcttgggccaccagcatcatcaatgaacgcattaggtgacaaggttggttcagctctcattgctcaagcagcaggggttccgactcttgcttggagtggatcacatgtggaaattccattagaactttgcttggactctatacctgaggagatgtataggaaagcttgtgttactaccgcggatgaagcagttgcaagttgtcagatgattggttatcctgccatgatcaaggcatcctggggtggtggtggtaaagggattagaaaggttaataatgatgatgaggttaaagcactgtttaagcaagtacagggtgaagttcctggctccccaatatttatcatgagacttgcatctcagagtcgacatcttgaagtccagctgctttgtgatcaatatggcaatgtagcagcacttcacagtcgtgattgcagtgtgcaacgacgacaccaaaagataattgaggaaggaccagttactgttgctccccgtgagacagtgaaggagcttagagcaagcgcaaggaggcttgctaaggctgtgggatatgttggtgctgctactgttgaatatctctacagcatggagactggtgaatactattttctggagcttaatccacggttgcaggttga

SEQ ID NO: 85 - DNA, 732 bp, Lolium multiflorum
gcagagctacgtggaggggcttgggtcgtgattgatagcaagataaatccagatcgcattgagtgctatgctgagacaactgcaaaagggaatgttctcgagcctcaagggttgattgagatcaagttcaggtcagaggaactccaagaatgcatgggtaggcttgatccagaattgataaatctgaaagcacaactccagggagcaaagcatgaaaatggaagtctatctgatggagaatccattcagaagagcatcgaagctcgaaagaacagttgctgcctttgtacactcaaatcgcgatacggtttgctgaattgcatgatacttccctcagaatgcttgctaaaggtgtgattaggaaaattgtagattgggaagaatctcggtctttcttctacaagagattacggcggaggatatctgaggatgttcttgcaaaagaaataagaagtgtaattggtgtcgagtcttctcacaaatcagcaatggagttgattaagaagtggtacttggcttctgagacagctggaggaagcactgaatgggatgatgatgatgcttttgttgcctggagggagaaccctgaaaactacaaggagcatatcaaagagcttagggctcaaagggtatctcaggtgctctcagatgttgcagactccagttcggatttacaagccttgccacagggtctttccatgctactagataagatggatccctctaggagag

SEQ ID NO: 86 - DNA, 668 bp, Lolium multiflorum
cgttattgatctaaaacgatgctctgccagggccaacagaactacatactgctacgattttcccttggcatttgaaactgcagtgacgaagtcatggtctaacattcctagaaacaaccaatgttatgttaaagcgacagagctggtgtttgctgacaagaatgggtcgtggggcactcctataattcctatgcagcgtgctgctgggctcaatgacatcggtatggtagcctggatcttggacatgtccactcccgaatttcccagtggcagacagattattgttgtcgcaaatgatattacttttagagctggatcatttggcccaagggaagatgcattttttgaagctgttaccaacctggcttgtgagagaaagcttcctcttatctatttggctgcaaactctggtgctcggattggcattgccgatgaagttaaatctatcttccgtgttaaatggattgatgatagcaaccctgaacgtggatttgattacgtttatctgtctgaagaagactatggccgtattagctcttctgttatagcgcacaagacacagctagatagtggcgaaataaggtgggttatcgattctgttgtgggcaaggaggatgggctaggtgtggagaacatacatggaagtgctgctattgccagtgcgtatt

SEQ ID NO: 87 - DNA, 469 bp, Lolium multiflorum
agggcgtcctccaatgcgccattccttccaatggtcatttgacaagctatattatgaggaggagccgatgctccgccatgtggaacctcctctgtccacattccttgaattggacaaagtgaaattagaaggttacagtgacatgaaatacaatccatcgcgtgatcgccagtggcacatttacacactgaacagtgaagatccaaaatcaaatgaccaaaggatattccttcgtacagttgttagacagccaagtttaaccaatgggtttttgtttggaagtatcgacaatgaagtaggccgttctcaggccacatcgtcattcacatctaacagcatacttagatcattgattgcagcgctagaagaaatagagttacatgctcataataaggccatgaggtcacgccattcccacatgtatctgtgcatgttgagagaacaacggttgtctgatctaattccattt

SEQ ID NO: 88 - DNA, 4094 bp, Lolium multiflorum
cacttctaaagccacaagtagaggatcccattcgcaggcgatggggtgtaatggttgtaatcaagtctcttcagcttctgccaactgcaattgaagctgcattaaaggagacttcacattatggagcaggtgatgcaaatgtctccaatggtagtcctataagatctaataatagcaatatgctgcatattgctttggttggtatcagaaatcagatgagtactcttcaagacaggttcgtttacactctctactctttgcgattctttattcttgatgaaacacaaaatatcataagagtgattctatgaactggttctgaatttcatgaaatttttagttacaccctccactttgttttctctttttagtggtgatgaggatcaagcacaagaaaggatcaacaaactttccaagattttgagggataccactataacatcacatctcaatggtgctggtgttaggactgtcagctgcattatccaaagagatgaagggcgtcctccaatgcgccattccttccaatggtcatttgacaagctatattatgaggaggagccgatgctccgccatgtggaacctcctctgtccacattccttgaattggtatgcagctttagttttggcttatgttctcttcaacaataccagtacctctaataacttatctgtaaatacaggacaaagtgaaattagaaggttacagtgacatgaaatacaatccatcgcgtgatcgccagtggcacatttacacactgaacagtgaagatccaaaatcaaatgaccaaaggatattccttcgtacagttgttagacagccaagtttaaccaatgggtttttgtttggaagtatcgacaatgaagtaggccgttctcaggccacatcgtcattcacatctaacagcatacttagatcattgattgcagcgctagaagaaatagagttacatgctcataataaggccatgagttcatgccattcccacatgtatctgtgcatgttgagagaacaacggttgtctgatctaattccattttcaaggtcagtcaaaatatacttatgttctcaataaaatacactgcattaaatgtgctcatatgatgctcacttggtttgtgcttctcatggtgttaggatgatgggtgaagttggtcaagatgaggaggcagcatgcacacttttgaagcatatggttatgaatatatatgaacatgttggtgtcaggatgcatcgcctttctgtgtgccaatgggaagtgaagctatggttagattgtgatgggcaagccaatggtgcttggagagttgtcattaccaatataactgggcatacctgcactgttgatgtaagttaccttagcgattgctgtattgcactactatgtgaacaacagcatctacagttctgcatatcataaagaatgctacctctgatggccccatagatcatcatatatgattatattttagttagtaaatagaacatggtcatcatttccatcattcgtgtcatggacattctctcaactgatgcctttaaagggtctattaaagaccacttaaaaataattaagtactattttctctttattccaatactcttatatgctcacattcgtttgactttcagatttaccgagaagtagaagactccaatacgcatcagattttctaccgctctgccacacacacagctggtcctttgcatggcattgcattgcatgagccatacaaacgtttggctcctattgacatgaaacggtctgcggctaggaaaaacgaaactacatactgctatgatttcccattggtgagttggttgcgtttgttaatttactttttatctaacattagttcgcatgattaacctgatcaactgagtttgctaataatactctgtccacaggcatttgaaacagcattgaagaaattgtggaaatctagtgcttcacatcttgcagaaactaaccagcataatcagcagtatgctgaagtgacagagcttttatttgctgattcaactggatcatggggtactcctttggttccagttgaacgttctccatgtgtcaatgatatcggcattgttgcttggaagatgaagctctccacgccagaatttccaggcggccgggagattatagttgttgcaaatgacgtgacgtttaaagctgggtcttttggtcctagagaagatatattctttcatgctgctaccaatcttgcctgtgagaggaaaattcctctaatctacttgtcagcaactgctggtgctaggcttggtgtggcagaggaaataaagtcgtgcttccatgttggatggtctgatgaccagagtcctgaacgtggttttcactacatttacctcactgaagaagactattcacgtctaagctcttcagttatagcccatgaactgaaactagacagcggagaaaccagatggattgttgataccattgttgggaaagaggatggacttggttgtgagaatctgcatggtagtggtgccattgccagtgcctttgctaaggcatatagagagacctttactctgacatttgtgactggaaacgcagttggaattggggcttatcttgctcggctaggaatgcggtgtatacagcgacttgatcaatcaattcttttaactggtttttctgccctgaacaaacttctggggcgcgaggtttatagctctcagatgcaactgggtggccccaaaattatgggtacaaatggagtcgtccatctgacagtgccagatgatcttgaaggtgtttctgctatcttgaaatggctcagctatgttcctgcctatgttggcggtcctcttcctattctgaagcctcttgatccaccagatagagctgtaacatatttcccagagaattcatgtgatgcccgtgcagccatctgtgggattcaggacactcaaggcaagtggttgggtggtatgtttgacagagaaagctttgtggaaacattagaaggatgggcaaaaactgttattactggaagggcaaagctgggtgggattccagttggcgtcatagcagtggaaacccagacaatgatgcaagtaatcccttctgaccctggtcagcttgattccgctgagcgtgtagtccctcaagcaggacaggtgtggttcccagattcggcctcaaaaacagcgcaggcgttgctggatttcaaccatgaagggctcccattgttcatacttgctaactggagaggcttctctggtgggcaaagggatctgtttgaaggaatccttcaggctggctctacaattgttgagaacctgaggacctacaagcagccagcttttgtgtacatcccaaaggctggagagctgcgtggaggtgcatgggttgtggtggacagcaagatcaatcctgagcacattgagatgtatgcggagaggactgcaaagggaaatgtccttgagccagaagggctgattgagattaaatttaagccaaaagaagtggaagagagtatgataaggcttgaccctgagctggccagccttgattctagactcaaagaaatgaagaaagcaaatgctagcctgcaggaaacggaggccatcaacaggagcatcaacaaccggataaagaagctgatgcccatctatacgcaggttgccacacggtttgctgaattgcacgacacctcttccagaatgactgccaaaggtgtgatcagtaaggtggttgattgggaggagtctcggagcttcttctacaggaggttgcgaaggcgggtcgcggaggattcccttgcccaggaagttaaagaagccgctggtgagccgatgcctcacagagcagcactggagcgtatcaagcagtggtatctggcctccaagggttccgaaggagacggtgagaagtggaacgatgacgaggctttcttcgcctggaaagacgatgccaagaactacgagaaccatcttcaggagttgaaggctgaaagagtatctagactgttctcggatcttgctgaaagctcggacgtgaaggccttgcccaacggtctttcgcgcctccttggcaaagtaagttctgcttcttcttttctta

SEQ ID NO: 89 - DNA, 3198 bp, Lolium multiflorum
ctagttcttgactcgagaagaaggtctgcagccagcagcctcgttcgttaactcggcgagcaaaggaaacaaggtaaacacacgatcctggcaaacacttttctttcttctctgaattgaagtcgtcgatatcgtgatgtttcatcttcgttacaataagcttggatgacggggagggtacttgcgttggctaggcagtcgtttcgacaaagctggtggtggtgtgtcaactccaaaagccaacctgcttttcgtttctggcaacaaccctcccctgttcaaaaaccttgtcctgtcaaatcccagcttgccgaaacgtcctactgctggcaccccttgtacctcttgttctaggtttgatcaaagttgatctttgtcaaattttactagattttttttacatctatacaacatatttgtacagtacatgtgcataccgatcgatataattttgttggtgctcgcagagtttgactagcatgtagcaggagcagtgatttatgctactactacttattgtactccagtaggatctacaatagtactagtatcgtagtcgtcgaatttagtcagtggtagcaaacaccaaacagcgagcagagaacgtcgccttcgccgccgtgatgctgctgggttgggggtttagctcagctacctcccaactaattccatccttccccaaatcaaataaaaaagaaaagaaaataaataaaaccagtccaccccacagtccaaatccaagtcccaagtcccaacccagctcctctcgctcacgccttccggcctccctctctaccccgtcccgtgttccggccccagccgagcgtcgcatggcggggccgccggtggcacggcagttataagccgcgcgcggccaaccatccagcgagagcacagcacagtagcatagctacctcgcagcacgccctccctccctgctagctactcctcctctgcagactgcagcgggtgggggagaggaggcgcgcatttaagcccggcctcctcacctgtcggcctgccgccgcgcccgacgccgaggccttcccttcccggatcttgatctgcccgccttcctcctcctcggcggcattccgtcgaacgggcggcgcgcgcctacggcagtacggtacctaccctgccttctctccccccatctcccctgctcgccgtgtacgcgccagcgttgggcaccccgcacaaatctaccacacaatttcgctctccccggctcagtcagtcgccgctgtgcgtagatcgcttccacttcctgctgggcgctcctggacgttccgtcgagcggtttctgagattgggctgaggggatcataccggcttccttttctgtcctcttttctgttccgttgcgtgcaggaattgttgtctgctcccacgcctttgcttgctcacctattccgtggactcccctgtgatcacaacatactcagcatactttttcttcacatgcctaggataatgaaatcgcaatctatgtaccatcgctgtcgcgatttctgctggctgttgactactaattttaccccttcacttgtgtacttatcctcgtaccgctgcttgaggaatttcatatttggctgcttgaggaatttcataaatctggctagacactcttcatgtttttgttcttacatctagtagtagttcagaaagaggaagcacagacgagcaactgacgtatccgtgcaattgttcgctagtcagaatgacagaatcgacgtgctcatttatatacctgatgtaattgtgcgcttctcctcaagccgtagcttgaggcgtttcattttgttcgtttgcgaaaagtttgatgaggaatttcatggtctggctacgtactcaccttgtttgtttgcatcattttagcatcaagttcagaaacaataaataccctacttgtgcaatcattcgctaacagaatcgacaatgctaacggtttttctgtccgttgcttgtccagcgctgaaggctagagggcggcgacaatggtggcggaaccggacaagacaaatgggacgcccaacaggatgtccagtaacaggcacctgtcctcgccgtccgtggtcgacgagttctgcaaggcgctcgggggcgattcgcccatccacagcgtcctggtcgccaacaatggaatggccgccgtcaagttcatgcgcagcatccgcacctgggccctcgagacgtttgggaccgagaaggccattctcctggtggccatggcaactccggaggacctcaggataaacgccgagcacataaggatcgccgaccagttcttggaagtccctggcggaacaaacaataacaattatgcgaatgtgcagctcattgtggaggttagcacgacgaccattctcccggtcctttttactagcttgttgatttagcgtatccatgtttcttgtgctggatatttgactagttacttaatgtttctaccttcactgtcacagatagcggagagaactcgggtttctgcggtttggcctggctggggccatgcttctgagaacccggaacttccagacgcgctcaaggagaagggaatcatttttcttgggccaccatcagccgcgatggctgcacttggtgataagattggttcttctcttattgcgcaagcagcaggagttccgactcttccatggagtggatcacatgtatacgttcttctatttctgtatagttttgctcctctttttttatcggctgctatgttgcttaaaattaaatccaaatcaactgtaggtgaaagttccgcaagaaacctgccacttgatacctgaggacatctataagaaagcttgtgttacaactacggaggaagcggtggctagttgtcaggtggtggggtatcctgcaatgatcaaggcatcatggggtggtggtggtaaaggaataaggaaggttggtcttctttttagttcgactctaccgcaattatatggaaagtctctgttcacaaacgatacatggaaatgtccactgtccatacaaaacgaagctaggtttcggcaaatattgtagaataaacgaaagatgattttgatgtcatccaaatgctttttataggtccacaatgatgatgaggtgagagccttgtttaagcaagtgcaaggagaagtccccggatcacctatatttatcatgaaggtggcatctcaggtgataagtgataacagc

SEQ ID NO: 90 - DNA, 511 bp, Lolium multiflorum
ctaataacttatctgtaaatacaggacaaagtgaaattagaaggttacagtgacatgaaatacaatccatcgcgtgatcgccagtggcacatttacacactgaacagtgaagatccaaaatcaaatgaccaaaggatattccttcgtacagttgttagacagccaagtttaaccaatgggtttttgtttggaagtatcgacaatgaagtaggccgttctcaggccacatcgtcattcacatctaacagcatacttagatcattgattgcagcgctagaagaaatagagttacatgctcataataaggccatgagttcacgccattcccacatgtatctgtgcatgttgagagaacaacggttgtctgatctaattccattttcaaggtcagtcaaaatatacttatgttctcaataaaatacactgcattaaatgtgctcatagatgctcacttggtttgtgcttctcatggtgttaggatgatgggtgaagttggtcaagatgaggagat

SEQ ID NO: 91 - DNA, 252 bp, Lolium multiflorum
ttctctgtagagccgacatctagaggttcagctgctctgtgacaaacacggcaatgtagcagcactgcacagtcgagactgtagtgttcaaagaaggcaccaaaaggttagaaattctcctgaaaagttatgttgtccaatatcagtttccttggagctaatacatgccgaaacattgtatactgagtactggtagaagttctgtagctttagggattggcaaagtgctaaactctgcagaagctatacaaa

SEQ ID NO: 92 - DNA, 1913 bp, Sorghum halepense
ctcacagatgtatctgtgcttactgagagaacaacaattgcatgaactaattccattttcaaggatgactgatgaaattgatcaggatgaaggaactgcatgtacacttttgaagcatatggtattgaatttatatgaacatgttggggtcaggatgcatcgtctttctgtgtgccagtgggaagtcaagctctggttggtttgtgatgggcaagctagtggtgcttggagagttgttgttaccaatgttactggtcacacctgcaccattgatatttaccgagaagtggaagaccccagcacacatcagcttctctaccactctgccacagccacggctggtcctttgcatggtgttgcattgaatgaaccatacaagcctttggacgctattgacctcaaacgttatgctgctaggaaaaatgaaaccacatactgctacgatttccccttggcatttgaaacagcgctgaagagattatggaaatcaagtagctatggtgttagtgaagctaatgagcgcaatcaactctatgctgaagtgaaagagcttatatttgttgattcggatggagcatggggcactccattggtttcatttgaacgccctccaggcatcaatgatattggcattgttgcttggaacatgaagctgtccacgccagaattcccaagtggccgggagattatagttgttgccaatgatgtgacatttaaagctgggtcctttggtccaagagaagatgcattttttgatgctgttaccaatcttgcctgtgagaggaaacttcctcttatctatctggcagcaactgctggtgccaggcttggtgtagctgaggaaataaagtcatgcttccatgtcggctggtctgatgatgagagccctgaacgtggttttcagtacatttacctcactacacaagattattcacgtctaagctcttcagtaatagctcacgagctgcaactagaaaatggagaaaccagatgggtggttgataccattgttggtaaagaggatggacttggttgtgagaatctccatggaagtggtgcgattgccagtgcatattccaaggcatacaaagagacctttactctgacatttgtgactggaagagctgttggcattggggcttatctggctcgtttaggtatgaggtgtatacaacgtcttgatcaaccaattattctgactgggttttctgcactaaacaagcttctggggcgggaggtgtacagttctcatatgcaattgggtggccccaaaatcatggctacaaatggtgttgtccaccaaactgtgtcagatgaccttgaaggtgtttctgctatcctgaaatggctcagttatgttcctccatatgttggtggtcctcttcccattatgaaacccctggacccacccgaaagaccagtagcatacttccctgagaatgcttgtgatgctcgtgcagccatctgtggcattcaagacggtgaagggaagtggttaggtggtatgtttgatagggaaaccttcgtggaaacattggaaggttgggcaaaaacagttatcaccggaagagcaaagcttggtggaataccagttggtgtcatagctgtggaaacccagactgtgatgcaagtcatcccagctgatccaggtcagcttgattccgctgagcgtgtagtccctcaagcaggtcaggtgtggttcccagattctgcagccaaaacagctcaggcattaatggatttcaaccgtgaggagcttccactgttcatccttgcaaactggagaggtttctctggtgggcaaagggatttatttgaaggaatccttcaggctggttcaacaattgttgagaatctgaggacgtacaagcagcctgcttttgtatatatcccaatgggtggagagctacggg

SEQ ID NO: 93 - DNA, 200 bp, Abutilon theophrasti
ttgctgtaactgatcttgcctgcagtaagaaactgcctttaatttatttggctgcgaactctggtgctcgtattggggtagctgaagaagtcaaagcctgctttaaagttggttggtctgatgaatccagccctgagcgtggttttcagtacatttacataactcctgaggattatactaggattggatcatcggtcatt

SEQ ID NO: 94 - DNA, 200 bp, Abutilon theophrasti
aatgaccgatgatccaatcctagtataatcctcaggagttatgtaaatgtactgaaaaccacgctcagggctggattcatcagaccaaccaactttaaagcaggctttgacttcttcagctaccccaatacgagcaccagagttcgcagccaaataaattaaaggcagtttcttactgcaggcaagatcagttacagcaa

SEQ ID NO: 95 - DNA, 200 bp, Abutilon theophrasti
tactaggattggatcatcggtcattgcacatgagatgaagctggccagtggagagagcagatgggtgatagatactattgttgggaaggaggatggtttgggggatcgagaacttaacaggtagtggagccattgctggtgcatactctcgggcatacaaagaaacctttaccctaacgtatgtgactggtagaactgtg

SEQ ID NO: 96 - DNA, 200 bp, Abutilon theophrasti
cacagttctaccagtcacatacgttagggtaaaggtttctttgtatgcccgagagtatgcaccagcaatggctccactacctgttaagttctcgatcccccaaaccatcctccttcccaacaatagtatctatcacccatctgctctctccactggccagcttcatctcatgtgcaatgaccgatgatccaatcctagta

SEQ ID NO: 97 - DNA, 200 bp, Abutilon theophrasti
aacgtatgtgactggtagaactgtgggaattggtgcttatcttgctcgtcttggcatgcggtgtatacaaagactcgatcaacccattattttgactggtttctcagcattgaacaaacttctaggtcgtgaggtgtatagctcccacatgcaacttggtggacctaaaatcatggcaacaaatggggtggttcatctca

SEQ ID NO: 98 - DNA, 200 bp, Abutilon theophrasti
tgagatgaaccaccccatttgttgccatgattttaggtccaccaagttgcatgtgggagctatacacctcacgacctagaagtttgttcaatgctgagaaaccagtcaaaataatgggttgatcgagtctttgtatacaccgcatgccaagacgagcaagataagcaccaattcccacagttctaccagtcacatacgtt

SEQ ID NO: 99 - DNA, 200 bp, Abutilon theophrasti
gcaacaaatggggtggttcatctcaccgtctcagatgatcttgaaggggtgtcagctattttgaactggataagttgcatacctcctcatattggtggtccacttcccattttaaacccatcagatcctccagaaaggcctgtggagtacatcccggaaaattcatgtgatcctcgtgccgctatttgtggtgctttaga

SEQ ID NO: 100 - DNA, 200 bp, Abutilon theophrasti
tctaaagcaccacaaatagcggcacgaggatcacatgaattttccgggatgtactccacaggcctttctggaggatctgatgggtttaaaatgggaagtggaccaccaatatgaggaggtatgcaacttatccagttcaaaatagctgacaccccttcaagatcatctgagacggtgagatgaaccaccccatttgttgc

SEQ ID NO: 101 - DNA, 200 bp, Abutilon theophrasti
gtgccgctatttgtggtgctttagatagtaatggcaagtggaagggcggtatttttgacagggatagctttgtggagacgctcgaaggttgggctagaacagttgtcacaggaagggcaaagcttggaggaattcctgcaggaatagttgcagttgagacacagacggtgatgcaggttatccctgccgatccaggacaa

SEQ ID NO: 102 - DNA, 200 bp, Abutilon theophrasti
ttgtcctggatcggcagggataacctgcatcaccgtctgtgtctcaactgcaactattcctgcaggaattcctccaagctttgcccttcctgtgacaactgttctagcccaaccttcgagcgtctccacaaagctatccctgtcaaaaataccgcccttccacttgccattactatctaaagcaccacaaatagcggcac

SEQ ID NO: 103 - DNA, 200 bp, Amaranthus graecizans
aaatatactccttcccgtgatcgtcaatggcatctttacacggttattgataaaccactcattcggaggatgtttttgagaacccttgtaagacaacccatctctgagttcacaggcgtcgaactaagcgctcttgaaacacaaaagcccatctcttttacttcaagaagcatcctaaggtccttaacaaccgccatgga

SEQ ID NO: 104 - DNA, 200 bp, Amaranthus graecizans
tccatggcggttgttaaggaccttaggatgcttcttgaagtaaaagagatgggcttttgtgtttcaagagcgcttagttcgacgcctgtgaactcagagatgggttgtcttacaagggttctcaaaaacatcctccgaatgagtggtttatcaataaccgtgtaaagatgccattgacgatcacgggaaggagtatattt

SEQ ID NO: 105 - DNA, 200 bp, Amaranthus graecizans
taaggtccttaacaaccgccatggaggagttggaactcaatgcacatagtgcttcattgaaacccgatcacgctcatatgtacttgtacattgttcgagagcaacaaatatacgatcttgtgccatatcacagggaggtgaacatagattaccaacaagaagaggcttcggttcaattctttttggaagagctcgcgcat

SEQ ID NO: 106 - DNA, 200 bp, Amaranthus graecizans
atgcgcgagctcttccaaaaagaattgaaccgaagcctcttcttgttggtaatctatgttcacctccctgtgatatggcacaagatcgtatatttgttgctctcgaacaatgtacaagtacatatgagcgtgatcgggtttcaatgaagcactatgtgcattgagttccaactcctccatggcggttgttaaggacctta

SEQ ID NO: 107 - DNA, 200 bp, Amaranthus graecizans
attctttttggaagagctcgcgcatgaaatccacagtcttgctggtgtaaggatgcataaactaaatgtttgtgagtgggaagtgaaacttcggatatcttctcccgggaaagctaatggtttatggagggtggcggttactaatgtgactggtcagacctgttcggtacatgtttatcgtgaattggaagatagcaacc

SEQ ID NO: 108 - DNA, 200 bp, Amaranthus graecizans
ggttgctatcttccaattcacgataaacatgtaccgaacaggtctgaccagtcacattagtaaccgccaccctccataaaccattagctttcccgggagaagatatccgaagtttcacttcccactcacaaacatttagtttatgcatccttacaccagcaagactgtggatttcatgcgcgagctcttccaaaaagaat

SEQ ID NO: 109 - DNA, 200 bp, Amaranthus graecizans
accacgagaagatgctttcttccttgcggttacaaatcttgcttgtgcgaagaaacttcctcttatttatctggctgcaaattcaggagctcgacttggtgttgccgaagagctaaaatcctgctttaaagttggctggtcggatgagtcaaaccccgagagtggatttcagtatgtcttcttaaccccggaagattacg

SEQ ID NO: 110 - DNA, 200 bp, Amaranthus graecizans
cgtaatcttccggggttaagaagacatactgaaatccactctcggggtttgactcatccgaccagccaactttaaagcaggattttagctcttcggcaacaccaagtcgagctcctgaatttgcagccagataaataagaggaagtttcttcgcacaagcaagatttgtaaccgcaaggaagaaagcatcttctcgtggt

SEQ ID NO: 111 - DNA, 200 bp, Amaranthus graecizans
gtcttcttaaccccggaagattacgatcgtatcggatcgtcagtcatagcccacgagttaaaactcgaaagtggagaaaaaagatgggttatagacacagttgtcggaaaggaggacggattaggtgtcgagaatctatcaggaagtggtgctatagccagtgcatactcaagggcttacaaggaaacatttactctgac

SEQ ID NO: 112 - DNA, 200 bp, Amaranthus graecizans
gtcagagtaaatgtttccttgtaagcccttgagtatgcactggctatagcaccacttcctgatagattctcgacacctaatccgtcctcctttccgacaactgtgtctataacccatcttttttctccactttcgagttttaactcgtgggctatgactgacgatccgatacgatcgtaatcttccggggttaagaagac

SEQ ID NO: 113 - DNA, 200 bp, Amaranthus graecizans
cttacaaggaaacatttactctgacttttgtaactggtagaacggtcggtattggtgcctatcttgctcgccttgggatgcgttgtatacagaggcttgaccagcctataattctcacgggtttttctgcgttaaataaacttcttggtcgggaggtttacagttcacacatgcaacttggtggaccgaagattatgggc

SEQ ID NO: 114 - DNA, 200 bp, Amaranthus graecizans
gcccataatcttcggtccaccaagttgcatgtgtgaactgtaaacctcccgaccaagaagtttatttaacgcagaaaaacccgtgagaattataggctggtcaagcctctgtatacaacgcatcccaaggcgagcaagataggcaccaataccgaccgttctaccagttacaaaagtcagagtaaatgtttccttgtaag

SEQ ID NO: 115 - DNA, 200 bp, Amaranthus graecizans
acttggtggaccgaagattatgggcacaaacggggtagttcatcttacagtttccgatgatcttgaaggcatttcatctatcttgaagtggctgagctatgttccaccctatgcaggtggtgaacttccgatttctcggtgtttagaccctccagaaagacccgttgcgtatttgcctgaaaattcttgtgatcctcgtg

SEQ ID NO: 116 - DNA, 200 bp, Amaranthus graecizans
cacgaggatcacaagaattttcaggcaaatacgcaacgggtctttctggagggtctaaacaccgagaaatcggaagttcaccacctgcatagggtggaacatagctcagccacttcaagatagatgaaatgccttcaagatcatcggaaactgtaagatgaactaccccgtttgtgcccataatcttcggtccaccaagt

SEQ ID NO: 117 - DNA, 200 bp, Amaranthus graecizans
cctgaaaattcttgtgatcctcgtggtgctatatctggtacagttgactccaccggtaaatggcatgggggtattttcgacaaggatagttttgtggaaaccttagaaggctgggcacgaacagttgtcacgggaagggctaaacttggaggaattccagttgggatagttgccgttgagacgcagactgttatgcaagt

SEQ ID NO: 118 - DNA, 200 bp, Amaranthus graecizans
acttgcataacagtctgcgtctcaacggcaactatcccaactggaattcctccaagtttagcccttcccgtgacaactgttcgtgcccagccttctaaggtttccacaaaactatccttgtcgaaaatacccccatgccatttaccggtggagtcaactgtaccagatatagcaccacgaggatcacaagaattttcagg

SEQ ID NO: 119 - DNA, 200 bp, Amaranthus graecizans
ttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactaccacttttcattttagctaattggagaggtttctcgggtggacaaagg

SEQ ID NO: 120 - DNA, 200 bp, Amaranthus graecizans
cctttgtccacccgagaaacctctccaattagctaaaatgaaaagtggtagttcttcccggttgaaatccatcagcgcttgtgctgtcttggatgcggaatctgggaaccatacttgccctgcttgtggtacgactctctcgtgtgagtcgagttgaccgggatctgctgggattacttgcataacagtctgcgtctcaa

SEQ ID NO: 121 - DNA, 200 bp, Amaranthus graecizans
gagaggtttctcgggtggacaaagggatctctttgaagggatccttcaagccggatccaccattgtcgaaaatcttaggacttataatcaacccgtttttgtttatataccaatgatgggggagcttcgaggaggcgcatgggtggtcgtggatagtcgaattaattccgatcatatagaaatgtacgccgaccaaacag

SEQ ID NO: 122 - DNA, 200 bp, Amaranthus graecizans
ctgtttggtcggcgtacatttctatatgatcggaattaattcgactatccacgaccacccatgcgcctcctcgaagctcccccatcattggtatataaacaaaaacgggttgattataagtcctaagattttcgacaatggtggatccggcttgaaggatcccttcaaagagatccctttgtccacccgagaaacctctc

SEQ ID NO: 123 - DNA, 200 bp, Amaranthus graecizans
atagaaatgtacgccgaccaaacagctaaaggaaatgtgcttgaacccgaaggaatgatcgagattaagttcagaaccaaggaacttctcgagtgtatgggaaggcttgatcaacaactcatcggtctcaaggaaaaactagcagaagccaagagctctaattcctacgataaaatcgaccccctgcagcaacaaataaa

SEQ ID NO: 124 - DNA, 200 bp, Amaranthus graecizans
tttatttgttgctgcagggggtcgattttatcgtaggaattagagctcttggcttctgctagtttttccttgagaccgatgagttgttgatcaagccttcccatacactcgagaagttccttggttctgaacttaatctcgatcattccttcgggttcaagcacatttcctttagctgtttggtcggcgtacatttctat

SEQ ID NO: 125 - DNA, 200 bp, Amaranthus hybridus
cactcgtcaagactgttcgagatgctgcaggtgaacggttgacccataagtcggctttggagttgatccggaaatggttcaatgagtcagatatttccggagaggcttccgatgcttgggctgatgatgcgaccttctttaagtggaaggacaataccgctaactacgaggagaagttgaaagagttgcgggttcagaag

SEQ ID NO: 126 - DNA, 200 bp, Amaranthus hybridus
cttctgaacccgcaactctttcaacttctcctcgtagttagcggtattgtccttccacttaaagaaggtcgcatcatcagcccaagcatcggaagcctctccggaaatatctgactcattgaaccatttccggatcaactccaaagccgacttatgggtcaaccgttcacctgcagcatctcgaacagtcttgacgagtg

SEQ ID NO: 127 - DNA, 200 bp, Amaranthus hybridus
gttgaaagagttgcgggttcagaaggtattggatcagctgtcgaatattggagattcggtaactaatttgagggctctgcctcagggtcttgctgccctacttcaaaaggtggatccatcgagtcgagaagaactagtcgaggaactccgaaaagtgctcacttgatttcgcaaccgttgatggtgaagtgaaaccttct

SEQ ID NO: 128 - DNA, 200 bp, Amaranthus hybridus
agaaggtttcacttcaccatcaacggttgcgaaatcaagtgagcacttttcggagttcctcgactagttcttctcgactcgatggatccaccttttgaagtagggcagcaagaccctgaggcagagccctcaaattagttaccgaatctccaatattcgacagctgatccaataccttctgaacccgcaactctttcaac

SEQ ID NO: 129 - DNA, 200 bp, Amaranthus hybridus
tatagatgaagtagtacagagtttgctggaatgccttgatagtcccgaacttccattccttcaatggcaagaatgcttgtctgtgctggcaacacgacttcccaaagatctgagatacgaattggaatcaaaatctagagcttttgaagggattaccaacacccagaacgtagaatttcctgctaagttgttgaaaagca

SEQ ID NO: 130 - DNA, 200 bp, Amaranthus hybridus
tgcttttcaacaacttagcaggaaattctacgttctgggtgttggtaatcccttcaaaagctctagattttgattccaattcgtatctcagatctttgggaagtcgtgttgccagcacagacaagcattcttgccattgaaggaatggaagttcgggactatcaaggcattccagcaaactctgtactacttcatctata

SEQ ID NO: 131 - DNA, 200 bp, Amaranthus hybridus
tttcctgctaagttgttgaaaagcattcttgaggaccatttaaactcatgccacgagaaagataaaggagctcaagagaggcttattgagcctcttatggctcttgtaaagtcttacgaaggtgggcgagaaagtcatgctcgttttattgttcaatctttatttgaagagtatttatccgttgaagaattgtttagcga

SEQ ID NO: 132 - DNA, 200 bp, Amaranthus hybridus
tcgctaaacaattcttcaacggataaatactcttcaaataaagattgaacaataaaacgagcatgactttctcgcccaccttcgtaagactttacaagagccataagaggctcaataagcctctcttgagctcctttatctttctcgtggcatgagtttaaatggtcctcaagaatgcttttcaacaacttagcaggaaa

SEQ ID NO: 133 - DNA, 200 bp, Amaranthus hybridus
tgaacatagattaccaacaagaagaggcttcggttcaattctttttggaagatctcgcgcatgaaatccatagtcttgctggtgtaaggatgcataaactaaatgtttgtgagtgggaagtgaaacttcggatatcatctcccgggaaagctaatggtttatggagggtggcagttactaatgtgactggtcatacctgt

SEQ ID NO: 134 - DNA, 200 bp, Amaranthus hybridus
acaggtatgaccagtcacattagtaactgccaccctccataaaccattagctttcccgggagatgatatccgaagtttcacttcccactcacaaacatttagtttatgcatccttacaccagcaagactatggatttcatgcgcgagatcttccaaaaagaattgaaccgaagcctcttcttgttggtaatctatgttca

SEQ ID NO: 135 - DNA, 200 bp, Amaranthus hybridus
tactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatctcccgtaagcgacttcaggccatgaagagtagcacaacatactgttacg

SEQ ID NO: 136 - DNA, 200 bp, Amaranthus hybridus
cgtaacagtatgttgtgctactcttcatggcctgaagtcgcttacgggagatgccaccgagtggttgatagggtgcattcacaggtaccccatggtgggggccgtgaacagatactgaatggtagaccatttcatgtaggttgctatcttccaattcacgataaacatgtaccgaacaggtatgaccagtcacattagta

SEQ ID NO: 137 - DNA, 200 bp, Amaranthus hybridus
aagagtagcacaacatactgttacgattttccactggctttctcaactgccctgaagcaatcatgggcatcggaagctccggatgtcaagaaaccctcggacaaagcacttttgaaagtaaccgagctagcatttgctgatccaaaaggcacatggggaactccgcttgttccaataaatcgcaagcctggtatgaacga

SEQ ID NO: 138 - DNA, 200 bp, Amaranthus hybridus
tcgttcataccaggcttgcgatttattggaacaagcggagttccccatgtgccttttggatcagcaaatgctagctcggttactttcaaaagtgctttgtccgagggtttcttgacatccggagcttccgatgcccatgattgcttcagggcagttgagaaagccagtggaaaatcgtaacagtatgttgtgctactctt

SEQ ID NO: 139 - DNA, 200 bp, Amaranthus hybridus
taaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcctcttatt

SEQ ID NO: 140 - DNA, 200 bp, Amaranthus hybridus
aataagaggaagtttcttcgcgcaagcaagatttgtaacagcaaggaagaaagcatcttctcgtggtccgaaagatccggccttgaaggtaacatcattagctacaaccattattgttcttccgttagggaactcgggggtggacatttccaagtaccaggctaccatgccaacatcgttcataccaggcttgcgattta

SEQ ID NO: 141 - DNA, 200 bp, Amaranthus hybridus
ttgcgcgaagaaacttcctcttatttatctggctgccaattcaggagctcgacttggtgttgccgaagagctaaaatcctgctttaaagttggctggtcggatgagtcaaaccccgagagtggatttcagtatgtctacttaacccctgaagattacgatcgtataggatcgtcagtcatagcccacgagttaaaactcg

SEQ ID NO: 142 - DNA, 200 bp, Amaranthus hybridus
cgagttttaactcgtgggctatgactgacgatcctatacgatcgtaatcttcaggggttaagtagacatactgaaatccactctcggggtttgactcatccgaccagccaactttaaagcaggattttagctcttcggcaacaccaagtcgagctcctgaattggcagccagataaataagaggaagtttcttcgcgcaa

SEQ ID NO: 143 - DNA, 200 bp, Amaranthus hybridus
gtcatagcccacgagttaaaactcgaaagtggagaaaaaagatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgc

SEQ ID NO: 144 - DNA, 200 bp, Amaranthus hybridus
gcaagataggcaccaataccgaccgttctaccggttacaaaagtcagagtaaatgtttccttgtaagcccttgagtatgcactggctatagcaccacttcctgatagattctcgacacctaatccgtcctccttaccgacaacggtgtctataacccatcttttttctccactttcgagttttaactcgtgggctatgac

SEQ ID NO: 145 - DNA, 200 bp, Amaranthus hybridus
cggtcggtattggtgcctatcttgctcgtcttgggatgcgttgtatacagaggcttgaccagcctataattctcacgggtttttctgcgttaaataaacttctcggtcgggaggtttacagttcacacatgcaacttggtggaccgaagataatgggcacaaacggggtagttcatcttacagtttccgatgatcttgaa

SEQ ID NO: 146 - DNA, 200 bp, Amaranthus hybridus
ttcaagatcatcggaaactgtaagatgaactaccccgtttgtgcccattatcttcggtccaccaagttgcatgtgtgaactgtaaacctcccgaccgagaagtttatttaacgcagaaaaacccgtgagaattataggctggtcaagcctctgtatacaacgcatcccaagacgagcaagataggcaccaataccgaccg

SEQ ID NO: 147 - DNA, 200 bp, Amaranthus hybridus
tcttacagtttccgatgatcttgaaggcatttcatctatcttgaagtggctgagctatgttccaccctattcaggtggtgaacttccgatttctcggtgtttagaccctcccgaaagaccggttgcgtatttgcctgaaaattgttgtgatcctcgtggggctatatctggtacggttgactccgccggtaaatggtttg

SEQ ID NO: 148 - DNA, 200 bp, Amaranthus hybridus
caaaccatttaccggcggagtcaaccgtaccagatatagccccacgaggatcacaacaattttcaggcaaatacgcaaccggtctttcgggagggtctaaacaccgagaaatcggaagttcaccacctgaatagggtggaacatagctcagccacttcaagatagatgaaatgccttcaagatcatcggaaactgtaaga

SEQ ID NO: 149 - DNA, 200 bp, Amaranthus hybridus
gttgactccgccggtaaatggtttgggggtattttcgacaaggatagttttgtggaaaccttagaaggatgggcacgaacagttgtcacgggaagggctaaactcggaggaattccagttggcatagttgctgttgagacacagactgttatgcaagtaatcccagcagatcccggtcaactcgactcacatgagagagt

SEQ ID NO: 150 - DNA, 200 bp, Amaranthus hybridus
actctctcatgtgagtcgagttgaccgggatctgctgggattacttgcataacagtctgtgtctcaacagcaactatgccaactggaattcctccgagtttagcccttcccgtgacaactgttcgtgcccatccttctaaggtttccacaaaactatccttgtcgaaaatacccccaaaccatttaccggcggagtcaac

SEQ ID NO: 151 - DNA, 200 bp, Amaranthus hybridus
gtcaactcgactcacatgagagagtcgtaccacaagcagggcaagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtc

SEQ ID NO: 152 - DNA, 200 bp, Amaranthus hybridus
gactatggtggatccagcctgaaggatcccttcaaagagatccctttgtccacccgagaaacctctccaattagctaaaatgaaaagtgggagttcttcccggttgaaatccatcagcgcttgtgctgtcttggatgcggaatctgggaaccatacttgccctgcttgtggtacgactctctcatgtgagtcgagttgac

SEQ ID NO: 153 - DNA, 200 bp, Amaranthus hybridus
ccttcaggctggatccaccatagtcgaaaatcttaggacttataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgatcgagatta

SEQ ID NO: 154 - DNA, 200 bp, Amaranthus hybridus
taatctcgatcattccttccggttcaagcacatttcctttagctgtttggtcggcgtacatttctatatggtcggaattaattcgactatcgacgaccacccatgcgcctcctcgaagctcccccatcatagggatataaacaaaaacgggttgattataagtcctaagattttcgactatggtggatccagcctgaagg

SEQ ID NO: 155 - DNA, 200 bp, Amaranthus hybridus
gaaccggaaggaatgatcgagattaagttccgaaccaaggaacttctcgagtgtatgggaaggcttgaccaacaactcatcggtctcaaggaaaaactagccgaagccaagagctctaattcctacgataaaatcgagcccctgcagcaacaaataaaagcccgcgagaagcaactattgcctctttatactcagatagc

SEQ ID NO: 156 - DNA, 200 bp, Amaranthus hybridus
gctatctgagtataaagaggcaatagttgcttctcgcgggcttttatttgttgctgcaggggctcgattttatcgtaggaattagagctcttggcttcggctagtttttccttgagaccgatgagttgttggtcaagccttcccatacactcgagaagttccttggttcggaacttaatctcgatcattccttccggttc

SEQ ID NO: 157 - DNA, 200 bp, Amaranthus lividus
aaagcattcttgaggaccatttaaattcatgccacgagaaagataaaggagctcaagagaggcttattgagcctcttatggctcttgtaaagtcttacgaaggtgggcgagaaagtcatgctcgttttattgttcaatctttatttgaagagtatttatccgttgaagaattgtttagcgacaatctccaggctgatgtg

SEQ ID NO: 158 - DNA, 200 bp, Amaranthus lividus
cacatcagcctggagattgtcgctaaacaattcttcaacggataaatactcttcaaataaagattgaacaataaaacgagcatgactttctcgcccaccttcgtaagactttacaagagccataagaggctcaataagcctctcttgagctcctttatctttctcgtggcatgaatttaaatggtcctcaagaatgcttt

SEQ ID NO: 159 - DNA, 200 bp, Amaranthus lividus
tagcgacaatctccaggctgatgtgattgaacgtctccgtcttcagtataagaaggatctgctgaagattgttgacattgtactgtcgcatcagggtgttaagaataaaataagctgattctacgactcatggaacagctggtttacccaaatcccgctgcatacagggggaaacttatccgtttctctcaattgaacca

SEQ ID NO: 160 - DNA, 200 bp, Amaranthus lividus
tggttcaattgagagaaacggataagtttccccctgtatgcagcgggatttgggtaaaccagctgttccatgagtcgtagaatcagcttattttattcttaacaccctgatgcgacagtacaatgtcaacaatcttcagcagatccttcttatactgaagacggagacgttcaatcacatcagcctggagattgtcgcta

SEQ ID NO: 161 - DNA, 200 bp, Amaranthus lividus
ttatccgtttctctcaattgaaccatacaatgtattctgagttggcactaaaggccagtcaattgcttgaacaaacgaaattgagtgagctccgttcgaacattgctagaaacctctctgagctagaaatgtttaccgaggatggcgaaaacatggatactccaaaaagaaaaagtgctattaatgaacgtatggaggcg

SEQ ID NO: 162 - DNA, 200 bp, Amaranthus lividus
cgcctccatacgttcattaatagcactttttctttttggagtatccatgttttcgccatcctcggtaaacatttctagctcagagaggtttctagcaatgttcgaacggagctcactcaatttcgtttgttcaagcaattgactggcctttagtgccaactcagaatacattgtatggttcaattgagagaaacggataa

SEQ ID NO: 163 - DNA, 200 bp, Amaranthus lividus
tgctattaatgaacgtatggaggcgcttgtgagtactcctctagctgtcgaagatgcccttgttggtttgtttgatcatagtgatcatacacttcagaggcgggttgttgagacctatgttcggaggctttatcagccttatcttgtcaagggaagtgtcaggatgctgtggcacagatcaggcttcatagctttatggg

SEQ ID NO: 164 - DNA, 200 bp, Amaranthus lividus
cccataaagctatgaagcctgatctgtgccacagcatcctgacacttcccttgacaagataaggctgataaagcctccgaacataggtctcaacaacccgcctctgaagtgtatgatcactatgatcaaacaaaccaacaagggcatcttcgacagctagaggagtactcacaagcgcctccatacgttcattaatagca

SEQ ID NO: 165 - DNA, 200 bp, Amaranthus lividus
agatcaggcttcatagctttatgggaatttgttgaggagaatattgaccgaacaaatttttctgatctgactacaaacagtgggaaccatagtgagcgaaagtggggggccatggtcgttattaaaactcttcagttcttgccatcggtaattgctgcagcattgagagaaacaactcatagttccgatcaatcaacttc

SEQ ID NO: 166 - DNA, 200 bp, Amaranthus lividus
gaagttgattgatcggaactatgagttgtttctctcaatgctgcagcaattaccgatggcaagaactgaagagttttaataacgaccatggccccccactttcgctcactatggttcccactgtttgtagtcagatcagaaaaatttgttcggtcaatattctcctcaacaaattcccataaagctatgaagcctgatct

SEQ ID NO: 167 - DNA, 200 bp, Amaranthus lividus
ctcatagttccgatcaatcaacttccactggctctatagaatcagtcatccatggaaatatgctgcacattgcactagtgggggtgaataaccagatgagcttgttgcaggatagtggtgatgaagatcaggctcaagagagaatcgataagttggccaaaattctgagagaacaagaagtgagttcagcccttcgtgct

SEQ ID NO: 168 - DNA, 200 bp, Amaranthus lividus
agcacgaagggctgaactcacttcttgttctctcagaattttggccaacttatcgattctctcttgagcctgatcttcatcaccactatcctgcaacaagctcatctggttattcacccccactagtgcaatgtgcagcatatttccatggatgactgattctatagagccagtggaagttgattgatcggaactatgag

SEQ ID NO: 169 - DNA, 200 bp, Amaranthus lividus
agaagtgagttcagcccttcgtgctgttggtgttggtgtgattagttgcatcatacagagagatgaagggcgaactccgatgaggcattcattctattggtcagcagaaaaacaatattatagtgaggaacctttactacgtcatttggaacccctctatctatgtatctcgagctggacaagcttaagggttatgaaga

SEQ ID NO: 170 - DNA, 200 bp, Amaranthus lividus
tcttcataacccttaagcttgtccagctcgagatacatagatagaggggttccaaatgacgtagtaaaggttcctcactataatattgtttttctgctgaccaatagaatgaatgcctcatcggagttcgcccttcatctctctgtatgatgcaactaatcacaccaacaccaacagcacgaagggctgaactcacttct

SEQ ID NO: 171 - DNA, 200 bp, Amaranthus lividus
cgagagtggatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgctatagccagtgcatactcaagggcttaca

SEQ ID NO: 172 - DNA, 200 bp, Amaranthus lividus
tgtaagcccttgagtatgcactggctatagcaccacttcctgatagattctcgacacctaatccgtcctccttaccgacaacggtgtctataacccatcttttttctccactttcgagttttaactcgtgggctatgactgacgatcctatacgatcgtaatcttcaggggttaagtagacatactgaaatccactctcg

SEQ ID NO: 173 - DNA, 200 bp, Amaranthus lividus
gccagtgcatactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcgggaggtttacagttcacacatgcaacttgg

SEQ ID NO: 174 - DNA, 200 bp, Amaranthus lividus
ccaagttgcatgtgtgaactgtaaacctcccgaccgagaagtttatttaacgcagaaaaacccgtgagaattataggctggtcaagcctctgtatacaacgcatcccaagacgagcaagataggcaccaataccgaccgttctaccggttacaaaagtcagagtaaatgtttccttgtaagcccttgagtatgcactggc

SEQ ID NO: 175 - DNA, 200 bp, Amaranthus lividus
tttacagttcacacatgcaacttggtggaccgaagataatgggcacaaacggggtagttcatcttacagtttccgatgatcttgaaggcatttcatctatcttgaagtggctgagctatgttccaccctattcaggtggtgaacttccgatttctcggtgtttagaccctcccgaaagaccggttgcgtatttgcctgaa

SEQ ID NO: 176 - DNA, 200 bp, Amaranthus lividus
ttcaggcaaatacgcaaccggtctttcgggagggtctaaacaccgagaaatcggaagttcaccacctgaatagggtggaacatagctcagccacttcaagatagatgaaatgccttcaagatcatcggaaactgtaagatgaactaccccgtttgtgcccattatcttcggtccaccaagttgcatgtgtgaactgtaaa

SEQ ID NO: 177 - DNA, 200 bp, Amaranthus lividus
aagaccggttgcgtatttgcctgaaaattgttgtgatcctcgtggggctatatctggtacggttgactcctccggtaaatggtttgggggtattttcgacaaggatagttttgtggaaaccttagaaggatgggcacgaacagttgtcacgggaagggctaaactcggaggaattccagttggcatagttgctgttgaga

SEQ ID NO: 178 - DNA, 200 bp, Amaranthus lividus
tctcaacagcaactatgccaactggaattcctccgagtttagcccttcccgtgacaactgttcgtgcccatccttctaaggtttccacaaaactatccttgtcgaaaatacccccaaaccatttaccggaggagtcaaccgtaccagatatagccccacgaggatcacaacaattttcaggcaaatacgcaaccggtctt

SEQ ID NO: 179 - DNA, 200 bp, Amaranthus lividus
ccagttggcatagttgctgttgagacgcagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagagg

SEQ ID NO: 180 - DNA, 200 bp, Amaranthus lividus
cctctccaattagctaaaatgaaaagtgggagttcttcccggttgaaatccatcagcgcttgtgctgtcttggatgcggaatctgggaaccatacttgccctgcttgtggtacgactctctcatgtgagtcgagttgaccgggatctgctgggattacttgcataacagtctgcgtctcaacagcaactatgccaactgg

SEQ ID NO: 181 - DNA, 200 bp, Amaranthus lividus
ttttcattttagctaattggagaggtttctcgggtggacaaagggatctctttgaagggatccttcaggctggatccaccatagtcgaaaatcttaggacttataatcaacccgtttttgtttatatccctatgatgggggagcttcgaggaggcgcatgggtggtcgtcgatagtcgaattaattccgaccatatagaa

SEQ ID NO: 182 - DNA, 200 bp, Amaranthus lividus
ttctatatggtcggaattaattcgactatcgacgaccacccatgcgcctcctcgaagctcccccatcatagggatataaacaaaaacgggttgattataagtcctaagattttcgactatggtggatccagcctgaaggatcccttcaaagagatccctttgtccacccgagaaacctctccaattagctaaaatgaaaa

SEQ ID NO: 183 - DNA, 200 bp, Amaranthus lividus
tcgaattaattccgaccatatagaaatgtacgccgatcaaacagctaaaggaaatgtgcttgaaccggaaggaatgatcgagattaagttccgaaccaaggaacttctcgagtgtatgggaaggcttgaccaacaactcatcggtctcaaggaaaaactagccgtagccaagagctctaattcctacgataaaatcgagc

SEQ ID NO: 184 - DNA, 200 bp, Amaranthus lividus
gctcgattttatcgtaggaattagagctcttggctacggctagtttttccttgagaccgatgagttgttggtcaagccttcccatacactcgagaagttccttggttcggaacttaatctcgatcattccttccggttcaagcacatttcctttagctgtttgatcggcgtacatttctatatggtcggaattaattcga

SEQ ID NO: 185 - DNA, 200 bp, Amaranthus lividus
ggcagttactaatgtgactggtcatacctgttcggtacatgtttatcgtgaattggaagatagcaacctacatgaaatggtctaccattcagtatctgttcacggcccccaccatggggtacctgtgaatgcaccctaccaaccactcggtggcatctcccgtaagcgacttcaggccatgaagagtagcacaacatact

SEQ ID NO: 186 - DNA, 200 bp, Amaranthus lividus
agtatgttgtgctactcttcatggcctgaagtcgcttacgggagatgccaccgagtggttggtagggtgcattcacaggtaccccatggtgggggccgtgaacagatactgaatggtagaccatttcatgtaggttgctatcttccaattcacgataaacatgtaccgaacaggtatgaccagtcacattagtaactgcc

SEQ ID NO: 187 - DNA, 200 bp, Amaranthus lividus
gccatgaagagtagcacaacatactgttatgattttccactggctttctcaactgccctgaagcaatcatgggcatcggaagctccggatgtcaagaaaccctcggacaaagcacttttgaaagtaaccgagctagcatttgctgatccaaaaggcacatggggaactccgcttgttccaataaatcgcaagcctggtat

SEQ ID NO: 188 - DNA, 200 bp, Amaranthus lividus
ataccaggcttgcgatttattggaacaagcggagttccccatgtgccttttggatcagcaaatgctagctcggttactttcaaaagtgctttgtccgagggtttcttgacatccggagcttccgatgcccatgattgcttcagggcagttgagaaagccagtggaaaatcataacagtatgttgtgctactcttcatggc

SEQ ID NO: 189 - DNA, 200 bp, Amaranthus lividus
ttccaataaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatgctttcttccttgctgttacaaatcttgcttgcgcgaagaaacttcct

SEQ ID NO: 190 - DNA, 200 bp, Amaranthus lividus
aggaagtttcttcgcgcaagcaagatttgtaacagcaaggaagaaagcatcttctcgtggtccgaaagatccggccttgaaggtaacatcattagctacaaccattattgttcttccgttagggaactcgggggtggacatttccaagtaccaggctaccatgccaacatcgttcataccaggcttgcgatttattggaa

SEQ ID NO: 191 - DNA, 200 bp, Amaranthus palmeri
aaaccaaaccaacctccttaaacttctcttcttctactcaccattttttcctctttttattgattattgattttaaatatacattatattgtaggaatttaatgaaattttcattaaattctgataaagttttgattttttttagtgtatgagatttttcagaagtacccaaatggtaaatttcaagtataatcaagttt

SEQ ID NO: 192 - DNA, 200 bp, Amaranthus palmeri
aaacttgattatacttgaaatttaccatttgggtacttctgaaaaatctcatacactaaaaaaaatcaaaactttatcagaatttaatgaaaatttcattaaattcctacaatataatgtatatttaaaatcaataatcaataaaaagaggaaaaaatggtgagtagaagaagagaagtttaaggaggttggtttggttt

SEQ ID NO: 193 - DNA, 200 bp, Amaranthus palmeri
gtaaatttcaagtataatcaagttttttagtacccaaagctctaaatgttacttaaagttttgatcttttaatggtttcttgtatttaatccaataatttaaagtacccagatttcaatttttagaataaattgagtttttgaattgcccaagttgtaattgttgctgaattctcttgctttgatttgggttttctgatt

SEQ ID NO: 194 - DNA, 200 bp, Amaranthus palmeri
aatcagaaaacccaaatcaaagcaagagaattcagcaacaattacaacttgggcaattcaaaaactcaatttattctaaaaattgaaatctgggtactttaaattattggattaaatacaagaaaccattaaaagatcaaaactttaagtaacatttagagctttgggtactaaaaaacttgattatacttgaaatttac

SEQ ID NO: 195 - DNA, 200 bp, Amaranthus palmeri
ttgctttgatttgggttttctgattctatcccttctgattcatacaggtattctgattttttcttgcttgattactttttgttagtgtatggttgagctaatttagtttatagtagtgtgaattttattttattttttttcaattttttcaattatttcaatttgtagagtagattctcctattatgatttgtttttgta

SEQ ID NO: 196 - DNA, 200 bp, Amaranthus palmeri
tacaaaaacaaatcataataggagaatctactctacaaattgaaataattgaaaaaattgaaaaaaaataaaataaaattcacactactataaactaaattagctcaaccatacactaacaaaaagtaatcaagcaagaaaaaatcagaatacctgtatgaatcagaagggatagaatcagaaaacccaaatcaaagcaa

SEQ ID NO: 197 - DNA, 200 bp, Amaranthus palmeri
tctcctattatgatttgtttttgtagctgggttttaatttttattgtctgatgatttatcttagcaatgttttaatgggtgtgctgtttttcaatttatagtgtaatttagttgattcctcttttccaatagagtgtacaaaaccgacctgattaactgaaaccgagtattatccaacgggaacaatccctgttacaaaa

SEQ ID NO: 198 - DNA, 200 bp, Amaranthus palmeri
ttttgtaacagggattgttcccgttggataatactcggtttcagttaatcaggtcggttttgtacactctattggaaaagaggaatcaactaaattacactataaattgaaaaacagcacacccattaaaacattgctaagataaatcatcagacaataaaaattaaaacccagctacaaaaacaaatcataataggaga

SEQ ID NO: 199 - DNA, 200 bp, Amaranthus palmeri
aacgggaacaatccctgttacaaaattcaaattagaatgtcaagtaccgaaatcaacccgaccccacatattatacccgagatccacccgaacacccgaatgaacacctctgagatcatagagaggatataaagaaaagtggaactagaatggggaatttagtttatttgagctacattgagcaaaattttttttagtga

SEQ ID NO: 200 - DNA, 200 bp, Amaranthus palmeri
tcactaaaaaaaattttgctcaatgtagctcaaataaactaaattccccattctagttccacttttctttatatcctctctatgatctcagaggtgttcattcgggtgttcgggtggatctcgggtataatatgtggggtcgggttgatttcggtacttgacattctaatttgaattttgtaacagggattgttcccgtt

SEQ ID NO: 201 - DNA, 200 bp, Amaranthus palmeri
cattgagcaaaattttttttagtgactgattattgtagctggcttttgttgtataactcatctaagcaatgtttttgatgtgtgtgcagtagcattggattgttttgattttttgttatattgtctatacaattcaaatcttgaatcacacttgacttttagttccattttcatcttcacaaattcttgtgagagactgt

SEQ ID NO: 202 - DNA, 200 bp, Amaranthus palmeri
acagtctctcacaagaatttgtgaagatgaaaatggaactaaaagtcaagtgtgattcaagatttgaattgtatagacaatataacaaaaaatcaaaacaatccaatgctactgcacacacatcaaaaacattgcttagatgagttatacaacaaaagccagctacaataatcagtcactaaaaaaaattttgctcaatg

SEQ ID NO: 203 - DNA, 200 bp, Amaranthus palmeri
ttcacaaattcttgtgagagactgtcaactgtgagacgctctctgtacatgggctaaatagcgtaactaatacaactattagcatatgagcttcttattttgaggtcgtctctcataagagtagctctctgttcttttatgatttatgattcaatgcaaataaattatttacggcccgtgtggtaggtggtaataaacaa

SEQ ID NO: 204 - DNA, 200 bp, Amaranthus palmeri
ttgtttattaccacctaccacacgggccgtaaataatttatttgcattgaatcataaatcataaaagaacagagagctactcttatgagagacgacctcaaaataagaagctcatatgctaatagttgtattagttacgctatttagcccatgtacagagagcgtctcacagttgacagtctctcacaagaatttgtgaa

SEQ ID NO: 205 - DNA, 200 bp, Amaranthus palmeri
ccgtgtggtaggtggtaataaacaatagtaatgagaatgaaaaacaagtgtaattttggttaaaaaatctcttggttacgttgatggtcatgcttgtccaacttaaatcatctcacactatcattgggagaggtggtgttaggtggtaatgaaaatttgtaaacaaaaaaacttgtttgtgatcaaagtttcattaccat

SEQ ID NO: 206 - DNA, 200 bp, Amaranthus palmeri
atggtaatgaaactttgatcacaaacaagtttttttgtttacaaattttcattaccacctaacaccacctctcccaatgatagtgtgagatgatttaagttggacaagcatgaccatcaacgtaaccaagagattttttaaccaaaattacacttgtttttcattctcattactattgtttattaccacctaccacacgg

SEQ ID NO: 207 - DNA, 200 bp, Amaranthus palmeri
tttgtgatcaaagtttcattaccataggaacgatacggaacttttgatgaaattttacactataaatcatttccattaccaccatttagtacctctaaccaaacgggacgttagagttttgcttacctacaatatcttcttagctcataagctcagaaccttacttcaattttgaccatatgtttctagctatactttca

SEQ ID NO: 208 - DNA, 200 bp, Amaranthus palmeri
tgaaagtatagctagaaacatatggtcaaaattgaagtaaggttctgagcttatgagctaagaagatattgtaggtaagcaaaactctaacgtcccgtttggttagaggtactaaatggtggtaatggaaatgatttatagtgtaaaatttcatcaaaagttccgtatcgttcctatggtaatgaaactttgatcacaaa

SEQ ID NO: 209 - DNA, 200 bp, Amaranthus palmeri
ccatatgtttctagctatactttcagtaagtatttaaaaattcattttcattttatctatgtatagttgcgaatgatgtttgttataaagggtcaatcgaaaaacttcctctttgttattagtaacaagggtaaggttatgtacatccaatccctccaaaccctttttgggtgggagctactaatggcgctgggacaatg

SEQ ID NO: 210 - DNA, 200 bp, Amaranthus palmeri
cattgtcccagcgccattagtagctcccacccaaaaagggtttggagggattggatgtacataaccttacccttgttactaataacaaagaggaagtttttcgattgaccctttataacaaacatcattcgcaactatacatagataaaatgaaaatgaatttttaaatacttactgaaagtatagctagaaacatatgg

SEQ ID NO: 211 - DNA, 200 bp, Amaranthus palmeri
agctactaatggcgctgggacaatggagttgttgtttgtcgaattcaagcggggaagtttgtttagaatgaatgttatttctaaaaatagatggtataagtatgttaatcaacaattaataatagagaactgttttattggtgtgataaacagtttcaggagcagtggtctcattttcgagcaatacaaaaagtgccgtg

SEQ ID NO: 212 - DNA, 200 bp, Amaranthus palmeri
cacggcactttttgtattgctcgaaaatgagaccactgctcctgaaactgtttatcacaccaataaaacagttctctattattaattgttgattaacatacttataccatctatttttagaaataacattcattctaaacaaacttccccgcttgaattcgacaaacaacaactccattgtcccagcgccattagtagct

SEQ ID NO: 213 - DNA, 200 bp, Amaranthus palmeri
ttcgagcaatacaaaaagtgccgtgcttctctaaacaacgacgattcagacatgacttctccttcccacaataatgaaaacccgaacggaccgatgatgccactcctgaggaattcatctgtagtatccattgttgataagttctgttatgctcttggagggacgcggccaatccatagtattttgatagcaaacaatgg

SEQ ID NO: 214 - DNA, 200 bp, Amaranthus palmeri
ccattgtttgctatcaaaatactatggattggccgcgtccctccaagagcataacagaacttatcaacaatggatactacagatgaattcctcaggagtggcatcatcggtccgttcgggttttcattattgtgggaaggagaagtcatgtctgaatcgtcgttgtttagagaagcacggcactttttgtattgctcgaa

SEQ ID NO: 215 - DNA, 200 bp, Amaranthus palmeri
atagtattttgatagcaaacaatgggatggctgctgtcaaatttataagaagtatccgaacatgggcttacgagacttttggtactgagaaggctatattattggtagccatggctactcccgaagacatgaaaatcaatgccgagcatattcgaatggctgatcagtttgttgaagtccccggaggaactaacaataat

SEQ ID NO: 216 - DNA, 200 bp, Amaranthus palmeri
attattgttagttcctccggggacttcaacaaactgatcagccattcgaatatgctcggcattgattttcatgtcttcgggagtagccatggctaccaataatatagccttctcagtaccaaaagtctcgtaagcccatgttcggatacttcttataaatttgacagcagccatcccattgtttgctatcaaaatactat

SEQ ID NO: 217 - DNA, 200 bp, Amaranthus palmeri
agtccccggaggaactaacaataataactacgccaatgtgcagctcattgttgaggtaatgtatcgtgagattagaaatttctagcctgtaatccatagttacatggaatgtggaacatagccacgttccgcgattcgggaacattcaatcccaatcaccatgaaacccgacctaaatcactaaaggtgacgtcccggtg

SEQ ID NO: 218 - DNA, 200 bp, Amaranthus palmeri
caccgggacgtcacctttagtgatttaggtcgggtttcatggtgattgggattgaatgttcccgaatcgcggaacgtggctatgttccacattccatgtaactatggattacaggctagaaatttctaatctcacgatacattacctcaacaatgagctgcacattggcgtagttattattgttagttcctccggggact

SEQ ID NO: 219 - DNA, 200 bp, Amaranthus palmeri
aatcactaaaggtgacgtcccggtgtagaacaccttttttttaaaatgtatttttggccttcatttacaaattaaaggaaaaagaaaggaggaaaaaacaagatgtaacccagaaacctaaacaaatccacttgaaaataatttcttaaagcaaattaatcattttagtttaattttgtttcaaatatatatattataca

SEQ ID NO: 220 - DNA, 200 bp, Amaranthus palmeri
tgtataatatatatatttgaaacaaaattaaactaaaatgattaatttgctttaagaaattattttcaagtggatttgtttaggtttctgggttacatcttgttttttcctcctttctttttcctttaatttgtaaatgaaggccaaaaatacattttaaaaaaaaggtgttctacaccgggacgtcacctttagtgatt

SEQ ID NO: 221 - DNA, 200 bp, Amaranthus palmeri
ttgtttcaaatatatatattatacataatgtgtctcatacccaatcgttcttgagtaaatctaggttgcgttctgtgttcccattcttgtttcccgttcgaaaccaaatgtcgttcagttaacaatgctgttatctgctttactgtgatttattaaatgtgtcctttgaaaaaaaggcaatatcagagcgactcgacgca

SEQ ID NO: 222 - DNA, 200 bp, Amaranthus palmeri
tgcgtcgagtcgctctgatattgcctttttttcaaaggacacatttaataaatcacagtaaagcagataacagcattgttaactgaacgacatttggtttcgaacgggaaacaagaatgggaacacagaacgcaacctagatttactcaagaacgattgggtatgagacacattatgtataatatatatatttgaaacaa

SEQ ID NO: 223 - DNA, 200 bp, Amaranthus palmeri
ggcaatatcagagcgactcgacgcagtttggcctggccggggacatgcgtaatatgtaatatgagattacaaatttataaccttttatatggtaaaatcttgtggtaggactaacttaaatcctttttctttcagttagcggaagttacacgagttgacgcagtttggcctggttggggacatgcatcggagatccccga

SEQ ID NO: 224 - DNA, 200 bp, Amaranthus palmeri
tcggggatctccgatgcatgtccccaaccaggccaaactgcgtcaactcgtgtaacttccgctaactgaaagaaaaaggatttaagttagtcctaccacaagattttaccatataaaaggttataaatttgtaatctcatattacatattacgcatgtccccggccaggccaaactgcgtcgagtcgctctgatattgcc

SEQ ID NO: 225 - DNA, 200 bp, Amaranthus palmeri
ggggacatgcatcggagatccccgagctgccagattcattagctacgaagggaattgtgtttctggggcccccagctgcatctatggctgctcttggagataaaattggttcatcattgattgcacaagctgcagatgtcccaactcttccatggagtggttctcatgtacgtactacacgttttttttttctttttttt

SEQ ID NO: 226 - DNA, 200 bp, Amaranthus palmeri
aaaaaaaagaaaaaaaaaacgtgtagtacgtacatgagaaccactccatggaagagttgggacatctgcagcttgtgcaatcaatgatgaaccaattttatctccaagagcagccatagatgcagctgggggccccagaaacacaattcccttcgtagctaatgaatctggcagctcggggatctccgatgcatgtcccc

SEQ ID NO: 227 - DNA, 200 bp, Amaranthus palmeri
tacacgttttttttttcttttttttttccttccaaatttctgatctttagagttttagtgatagatttatatacgtctctatccctcaggtgaaaattcctgctgagagttgcctagacgtaattcccgatgaagtatataaagcggcatgtgtttttactacagaggaagcaattgctagctgtcaagttgttggttat

SEQ ID NO: 228 - DNA, 200 bp, Amaranthus palmeri
ataaccaacaacttgacagctagcaattgcttcctctgtagtaaaaacacatgccgctttatatacttcatcgggaattacgtctaggcaactctcagcaggaattttcacctgagggatagagacgtatataaatctatcactaaaactctaaagatcagaaatttggaaggaaaaaaaaaagaaaaaaaaaacgtgta

SEQ ID NO: 229 - DNA, 200 bp, Amaranthus palmeri
tgctagctgtcaagttgttggttatccggctatgatcaaagcttcttggggtggtggagggaagggaataagaaaggtaaaatttttttggatgatgatgctcttaaaagactaaaaggaggttacacatatccccattacttgtttatcatcagaagcagagcaaaaattgacaaagatttaaagactctgtgcaattt

SEQ ID NO: 230 - DNA, 200 bp, Amaranthus palmeri
aaattgcacagagtctttaaatctttgtcaatttttgctctgcttctgatgataaacaagtaatggggatatgtgtaacctccttttagtcttttaagagcatcatcatccaaaaaaattttacctttcttattcccttccctccaccaccccaagaagctttgatcatagccggataaccaacaacttgacagctagca

SEQ ID NO: 231 - DNA, 200 bp, Amaranthus palmeri
aagatttaaagactctgtgcaatttcaaaaatatgatatatttctaacaacgtatcttcaaacactttaaacatactacctattttaatactgcggcccctatttttttgaggccgtgtgtggtcgaacatattgaatatgcttagaaccactcctgtttatcactaatatgccatcttccacagtcgaacctctacttt

SEQ ID NO: 232 - DNA, 200 bp, Amaranthus palmeri
aaagtagaggttcgactgtggaagatggcatattagtgataaacaggagtggttctaagcatattcaatatgttcgaccacacacggcctcaaaaaaataggggccgcagtattaaaataggtagtatgtttaaagtgtttgaagatacgttgttagaaatatatcatatttttgaaattgcacagagtctttaaatctt

SEQ ID NO: 233 - DNA, 200 bp, Amaranthus palmeri
tcttccacagtcgaacctctactttgacccagattccttgaaagggatttcgatttagactcgagctatggtcaattattagcaatagcaaaagcttcttaatagttaatagattctcaaacacttccgtcatgccaacactttatgaagactcatgggtattctctcttttaggttcataatgatgacgaagtacgggc

SEQ ID NO: 234 - DNA, 200 bp, Amaranthus palmeri
gcccgtacttcgtcatcattatgaacctaaaagagagaatacccatgagtcttcataaagtgttggcatgacggaagtgtttgagaatctattaactattaagaagcttttgctattgctaataattgaccatagctcgagtctaaatcgaaatccctttcaaggaatctgggtcaaagtagaggttcgactgtggaaga

SEQ ID NO: 235 - DNA, 200 bp, Amaranthus palmeri
ttcataatgatgacgaagtacgggcattatttaagcaagtgcagggtgaagttcccggctcacccatatttataatgaaggtggcttcacaggttagactttcttcaacattggtccgatattcgagtaaattgcattaaaaaaggttaaatatacaatttttttggataagtattgtatgagagactactactaagata

SEQ ID NO: 236 - DNA, 200 bp, Amaranthus palmeri
tatcttagtagtagtctctcatacaatacttatccaaaaaaattgtatatttaaccttttttaatgcaatttactcgaatatcggaccaatgttgaagaaagtctaacctgtgaagccaccttcattataaatatgggtgagccgggaacttcaccctgcacttgcttaaataatgcccgtacttcgtcatcattatgaa

SEQ ID NO: 237 - DNA, 200 bp, Amaranthus palmeri
tgtatgagagactactactaagataaagtattattaatatgtgcagagtcgacacttagaagtacagttactgtgtgatgaatatggcaatgttgcagcattgcatagccgtgattgcagtgtccaaaggcggcaccaaaaggtgggtctttggtagattatggttatgatctacggtttgttattgtttaagaaaaata

SEQ ID NO: 238 - DNA, 200 bp, Amaranthus palmeri
tatttttcttaaacaataacaaaccgtagatcataaccataatctaccaaagacccaccttttggtgccgcctttggacactgcaatcacggctatgcaatgctgcaacattgccatattcatcacacagtaactgtacttctaagtgtcgactctgcacatattaataatactttatcttagtagtagtctctcataca

SEQ ID NO: 239 - DNA, 200 bp, Amaranthus palmeri
ggtttgttattgtttaagaaaaatatttgattttaagcattatttagcttgctgggatttgaacttttctgttcatcattttaactaatcagatcattgaagaaggcccaataacaatagctccaccagaaacggtgaagaagcttgagcaagcagctagaagattggctttatgtgtgggttatgttggcgcagctaca

SEQ ID NO: 240 - DNA, 200 bp, Amaranthus palmeri
tgtagctgcgccaacataacccacacataaagccaatcttctagctgcttgctcaagcttcttcaccgtttctggtggagctattgttattgggccttcttcaatgatctgattagttaaaatgatgaacagaaaagttcaaatcccagcaagctaaataatgcttaaaatcaaatatttttcttaaacaataacaaacc

SEQ ID NO: 241 - DNA, 200 bp, Amaranthus palmeri
tgtgggttatgttggcgcagctacagttgaatatttatacagcatggaaacaggcgagttccatttccttgagttgaatcctcggttacaggtatggagcttccccaacttcttttaagtacccattatgtaactgcatatttatgtaatccctccattccaaattagtcgctatgtattcctatggggatgtcccaaat

SEQ ID NO: 242 - DNA, 200 bp, Amaranthus palmeri
atttgggacatccccataggaatacatagcgactaatttggaatggagggattacataaatatgcagttacataatgggtacttaaaagaagttggggaagctccatacctgtaaccgaggattcaactcaaggaaatggaactcgcctgtttccatgctgtataaatattcaactgtagctgcgccaacataacccaca

SEQ ID NO: 243 - DNA, 200 bp, Amaranthus palmeri
gtattcctatggggatgtcccaaattagttgcaacatttctgtatatggtaaagttttcccctccaaaccttaaaacctagttgaccataatctaactaaacccaattcttgacccactttgaaaaacaggtcaaatgttggtgtttgaaccacctttaaacaaatttaagattttgggttggtaatggcttatcagaga

SEQ ID NO: 244 - DNA, 200 bp, Amaranthus palmeri
tctctgataagccattaccaacccaaaatcttaaatttgtttaaaggtggttcaaacaccaacatttgacctgtttttcaaagtgggtcaagaattgggtttagttagattatggtcaactaggttttaaggtttggaggggaaaactttaccatatacagaaatgttgcaactaatttgggacatccccataggaatac

SEQ ID NO: 245 - DNA, 200 bp, Amaranthus palmeri
tgggttggtaatggcttatcagagatttgggtttttggcatcggcattattttggtgtcgatttgcaaatgatatcccgggatttcgaactaggaggggattcaattggtttttgaggaatttatgtaattattcctttaattagtgatcattgaattgattgtatttgtgttggggaattggacccgtgaagaaaaaaa

SEQ ID NO: 246 - DNA, 200 bp, Amaranthus palmeri
tttttttcttcacgggtccaattccccaacacaaatacaatcaattcaatgatcactaattaaaggaataattacataaattcctcaaaaaccaattgaatcccctcctagttcgaaatcccgggatatcatttgcaaatcgacaccaaaataatgccgatgccaaaaacccaaatctctgataagccattaccaaccca

SEQ ID NO: 247 - DNA, 200 bp, Amaranthus palmeri
ggaattggacccgtgaagaaaaaaatgacgggttagcttttggattagtgagtgattatgtgagtttaatttgtctatgaaaggtcaacttcaagcaacattttctgttttagcttagtaatttttgggatgcgatggaacatttgagcaccttctggattatcaacagaaatgatcatcgaaattgatttttttagttg

SEQ ID NO: 248 - DNA, 200 bp, Amaranthus palmeri
caactaaaaaaatcaatttcgatgatcatttctgttgataatccagaaggtgctcaaatgttccatcgcatcccaaaaattactaagctaaaacagaaaatgttgcttgaagttgacctttcatagacaaattaaactcacataatcactcactaatccaaaagctaacccgtcatttttttcttcacgggtccaattcc

SEQ ID NO: 249 - DNA, 200 bp, Amaranthus palmeri
tcatcgaaattgatttttttagttgttgacagtagaaaagtatcagataaggtagaataatacagtataatctttagttgcgacaatttccaacgtttttataatagctaaagctacattctcatgttgcttgatgaaagtgaccgtatttattctgtgtgcttatacaggtggagcatcctgttactgagtggattgcc

SEQ ID NO: 250 - DNA, 200 bp, Amaranthus palmeri
ggcaatccactcagtaacaggatgctccacctgtataagcacacagaataaatacggtcactttcatcaagcaacatgagaatgtagctttagctattataaaaacgttggaaattgtcgcaactaaagattatactgtattattctaccttatctgatacttttctactgtcaacaactaaaaaaatcaatttcgatga

SEQ ID NO: 251 - DNA, 200 bp, Amaranthus palmeri
gcatcctgttactgagtggattgccgaggtaaatcttccagctgctcaagttgcagttggcatgggtatcccactttggcaaattcctggtaaatgtccagtactcttttttcggttatgtaacttatatattatatctaattcttatttacgaaccgaattgatcacacatttttaaaacagaaatccgtcggttctat

SEQ ID NO: 252 - DNA, 200 bp, Amaranthus palmeri
atagaaccgacggatttctgttttaaaaatgtgtgatcaattcggttcgtaaataagaattagatataatatataagttacataaccgaaaaaagagtactggacatttaccaggaatttgccaaagtgggatacccatgccaactgcaacttgagcagctggaagatttacctcggcaatccactcagtaacaggatgc

SEQ ID NO: 253 - DNA, 200 bp, Amaranthus palmeri
taaaacagaaatccgtcggttctatgggaaggaacatggtgggggttatgatacttggatgaggacatctgctttggctactgcttttgattttaacgaggcacagtcggtgaaacctaaaggtcattgtattgctgcgcgtgtgacaagtgaggatcccgatgacggttttaagcctacaagcgggaaagtacaggtta

SEQ ID NO: 254 - DNA, 200 bp, Amaranthus palmeri
taacctgtactttcccgcttgtaggcttaaaaccgtcatcgggatcctcacttgtcacacgcgcagcaatacaatgacctttaggtttcaccgactgtgcctcgttaaaatcaaaagcagtagccaaagcagatgtcctcatccaagtatcataacccccaccatgttccttcccatagaaccgacggatttctgtttta

SEQ ID NO: 255 - DNA, 200 bp, Amaranthus palmeri
cctacaagcgggaaagtacaggttagaccatcctggttttgtcgatttacttccacaattggtcttgttttgtttttgcctttgcggtgaagaattttctttaatgggtgctttgtttaggagctgagttttaaaagtaaaccgaatgtgtgggcctacttctctgttaaggtattttccatatttctttaattctttga

SEQ ID NO: 256 - DNA, 200 bp, Amaranthus palmeri
tcaaagaattaaagaaatatggaaaataccttaacagagaagtaggcccacacattcggtttacttttaaaactcagctcctaaacaaagcacccattaaagaaaattcttcaccgcaaaggcaaaaacaaaacaagaccaattgtggaagtaaatcgacaaaaccaggatggtctaacctgtactttcccgcttgtagg

SEQ ID NO: 257 - DNA, 200 bp, Amaranthus palmeri
tttccatatttctttaattctttgattttcgcgtttacaatttcagttcactccattatgggcttgatgatgataaacacttttatttgcagtctgggggaggcattcatgagttctcggattctcaatttggtaagttaatggtgcaaactcttgtcagtaatgttaactacagtttcacatgatttactaatctcttc

SEQ ID NO: 258 - DNA, 200 bp, Amaranthus palmeri
gaagagattagtaaatcatgtgaaactgtagttaacattactgacaagagtttgcaccattaacttaccaaattgagaatccgagaactcatgaatgcctcccccagactgcaaataaaagtgtttatcatcatcaagcccataatggagtgaactgaaattgtaaacgcgaaaatcaaagaattaaagaaatatggaaa

SEQ ID NO: 259 - DNA, 200 bp, Amaranthus palmeri
tttcacatgatttactaatctcttcgtgaattgcgaactaaaaaagagaattattgtcagttttgggctattttttattccattttgagccaatggaaattcaaaaagcgaatagctagcgaattttgttgatattctggaggtgtatattgatgagaattttacaaaaagttgctgctgctgcactgtgttatttttta

SEQ ID NO: 260 - DNA, 200 bp, Amaranthus palmeri
taaaaaataacacagtgcagcagcagcaactttttgtaaaattctcatcaatatacacctccagaatatcaacaaaattcgctagctattcgctttttgaatttccattggctcaaaatggaataaaaaatagcccaaaactgacaataattctcttttttagttcgcaattcacgaagagattagtaaatcatgtgaaa

SEQ ID NO: 261 - DNA, 200 bp, Amaranthus palmeri
tgctgctgcactgtgttattttttagaaacactgggtgactttcaattgtttgtaaaacttgcatattcgagtcacaacatgatgtcataatgaaatgcgagcggtttttattaaataatagagccatagtgtaatcgaccaatatttaggtggtgcaatgaccgcatcactcccgttaccgcattaccgttccctaccg

SEQ ID NO: 262 - DNA, 200 bp, Amaranthus palmeri
cggtagggaacggtaatgcggtaacgggagtgatgcggtcattgcaccacctaaatattggtcgattacactatggctctattatttaataaaaaccgctcgcatttcattatgacatcatgttgtgactcgaatatgcaagttttacaaacaattgaaagtcacccagtgtttctaaaaaataacacagtgcagcagca

SEQ ID NO: 263 - DNA, 200 bp, Amaranthus palmeri
gttaccgcattaccgttccctaccgcgatcacgatcgttagcgcatttttacgctatgaatagaccttcagttcatattttatgatggctaaaatcaatcacttggttaatggtatatcatatacgaaggctaacaaaagaatttctttacaggccatgtttttgcatttggtgaaaaccgaggtttggccatagcaaat

SEQ ID NO: 264 - DNA, 200 bp, Amaranthus palmeri
atttgctatggccaaacctcggttttcaccaaatgcaaaaacatggcctgtaaagaaattcttttgttagccttcgtatatgatataccattaaccaagtgattgattttagccatcataaaatatgaactgaaggtctattcatagcgtaaaaatgcgctaacgatcgtgatcgcggtagggaacggtaatgcggtaac

SEQ ID NO: 265 - DNA, 200 bp, Amaranthus palmeri
aaaccgaggtttggccatagcaaatatgattcttggattaaaagaaattcaaattcgtggagaaattcgaactaatgttgattacaccatcgatcttttaaatgtgagtttgaatgtaatttttgttgtctttttttagttttcgcctttcttctgttaaacctttgaagttctcacacttaacttttttttcctccagt

SEQ ID NO: 266 - DNA, 200 bp, Amaranthus palmeri
actggaggaaaaaaaagttaagtgtgagaacttcaaaggtttaacagaagaaaggcgaaaactaaaaaaagacaacaaaaattacattcaaactcacatttaaaagatcgatggtgtaatcaacattagttcgaatttctccacgaatttgaatttcttttaatccaagaatcatatttgctatggccaaacctcggttt

SEQ ID NO: 267 - DNA, 200 bp, Amaranthus palmeri
acacttaacttttttttcctccagtgtttggattatagagaaaaccaaattcatacaggttggttggatagtagaattgcgatgagggttagagccgaaaggccaccttggtacatctctgttgtgggaggagggctttacgtatgtacaactttttcatagctatcattaatttttccgttgttatgatctgtgttact

SEQ ID NO: 268 - DNA, 200 bp, Amaranthus palmeri
agtaacacagatcataacaacggaaaaattaatgatagctatgaaaaagttgtacatacgtaaagccctcctcccacaacagagatgtaccaaggtggcctttcggctctaaccctcatcgcaattctactatccaaccaacctgtatgaatttggttttctctataatccaaacactggaggaaaaaaaagttaagtgt

SEQ ID NO: 269 - DNA, 200 bp, Amaranthus palmeri
ttccgttgttatgatctgtgttacttggactcgggttgttggatactggtatgtgtccacgtgtcggatacgtctaaatattcaattttacgcctaaaatgaagtatctaagtgccatgtccgagcatcaagaatcggacacgggtacgtgaagccaaatgaagagtccgagtaacataagttatgattaatgttaaata

SEQ ID NO: 270 - DNA, 200 bp, Amaranthus palmeri
tatttaacattaatcataacttatgttactcggactcttcatttggcttcacgtacccgtgtccgattcttgatgctcggacatggcacttagatacttcattttaggcgtaaaattgaatatttagacgtatccgacacgtggacacataccagtatccaacaacccgagtccaagtaacacagatcataacaacggaa

SEQ ID NO: 271 - DNA, 200 bp, Amaranthus palmeri
cataagttatgattaatgttaaataacttgttttctttatcctctatatccagaaagcatcgactagtagtgcagcgactgtttcagagtatataggctatcttgaaaaaggtcaaattcctccgaaggtatgtaacatacaattggttggcgggtgtttagattaacttattctattaatatcaattatactttcagtg

SEQ ID NO: 272 - DNA, 200 bp, Amaranthus palmeri
cactgaaagtataattgatattaatagaataagttaatctaaacacccgccaaccaattgtatgttacataccttcggaggaatttgacctttttcaagatagcctatatactctgaaacagtcgctgcactactagtcgatgctttctggatatagaggataaagaaaacaagttatttaacattaatcataacttatg

SEQ ID NO: 273 - DNA, 200 bp, Amaranthus palmeri
attaatatcaattatactttcagtgttctgctttaattctggtttcatgattgcagcatatatcactcgtccactatgaagttgctctaaatatcgaggggatgaaatataccgtatgttccatgccattcgtactttcctcgtgaatttttgttatggatgctatttttgacattttctttctaaatatattttcttga

SEQ ID NO: 274 - DNA, 200 bp, Amaranthus palmeri
tcaagaaaatatatttagaaagaaaatgtcaaaaatagcatccataacaaaaattcacgaggaaagtacgaatggcatggaacatacggtatatttcatcccctcgatatttagagcaacttcatagtggacgagtgatatatgctgcaatcatgaaaccagaattaaagcagaacactgaaagtataattgatattaat

SEQ ID NO: 275 - DNA, 200 bp, Amaranthus palmeri
tttctttctaaatatattttcttgaaattaatgaacatgtcgtttcggattgccagattgagatgattaggggtggaccaggaagctacaaaatgtggttgaatgggtccgtagttgaggcggaaatacatactttaagagatgggggtctcttgatgcaggtatcaaatgttttttgatatttttttttctgatatacg

SEQ ID NO: 276 - DNA, 200 bp, Amaranthus palmeri
cgtatatcagaaaaaaaaatatcaaaaaacatttgatacctgcatcaagagacccccatctcttaaagtatgtatttccgcctcaactacggacccattcaaccacattttgtagcttcctggtccacccctaatcatctcaatctggcaatccgaaacgacatgttcattaatttcaagaaaatatatttagaaagaaa

SEQ ID NO: 277 - DNA, 200 bp, Amaranthus palmeri
ttgatatttttttttctgatatacggtatttatattttatatccaaagcatggtgataataccctggatttgtaaagcattagataatatgttatcaaacaagtagaaggtagtttcgtgaaaccatgaagcgtttagtttagatttgaattttaatacttctacaatgcttgggatattaatcaataatcatgcttcta

SEQ ID NO: 278 - DNA, 200 bp, Amaranthus palmeri
tagaagcatgattattgattaatatcccaagcattgtagaagtattaaaattcaaatctaaactaaacgcttcatggtttcacgaaactaccttctacttgtttgataacatattatctaatgctttacaaatccagggtattatcaccatgctttggatataaaatataaataccgtatatcagaaaaaaaaatatcaa

SEQ ID NO: 279 - DNA, 200 bp, Amaranthus palmeri
atattaatcaataatcatgcttctaatagtaaagagaaatattgtcatagactcataggtataatggctcgttaaatcatatgcacttcttgtttatgtgaagtccgagttggtgtttgcaatcaacgtttgaaatcaagggcatagtgcaaaatctcgaatgtggtcacttttgtggtcaatgtagatggtttcatttc

SEQ ID NO: 280 - DNA, 200 bp, Amaranthus palmeri
gaaatgaaaccatctacattgaccacaaaagtgaccacattcgagattttgcactatgcccttgatttcaaacgttgattgcaaacaccaactcggacttcacataaacaagaagtgcatatgatttaacgagccattatacctatgagtctatgacaatatttctctttactattagaagcatgattattgattaatat

SEQ ID NO: 281 - DNA, 200 bp, Amaranthus palmeri
tggtcaatgtagatggtttcatttctatcgtggtataaatatgggtcgcagtaatcttaagaacctatatagtagacgataacttgttattaaaagggtaaaggctgcatacatccgatgtcccatttacccggtctagatgtgagctacttggggtttttgttattgaagttaaagatacaagaaggattattgctaaa

SEQ ID NO: 282 - DNA, 200 bp, Amaranthus palmeri
tttagcaataatccttcttgtatctttaacttcaataacaaaaaccccaagtagctcacatctagaccgggtaaatgggacatcggatgtatgcagcctttacccttttaataacaagttatcgtctactatataggttcttaagattactgcgacccatatttataccacgatagaaatgaaaccatctacattgacca

SEQ ID NO: 283 - DNA, 200 bp, Amaranthus palmeri
agatacaagaaggattattgctaaaaaaaaaaaagaatatttgaactacaaaaaaagtaattagtttatgtactagttcgttctagcccatataactcatttaaaaaaatatatgaaaaagggctttcaatgtcatgaacggaagggaggaaatggactgtggaagagtcaacaaagattacatatgaattctcttttgt

SEQ ID NO: 284 - DNA, 200 bp, Amaranthus palmeri
acaaaagagaattcatatgtaatctttgttgactcttccacagtccatttcctcccttccgttcatgacattgaaagccctttttcatatatttttttaaatgagttatatgggctagaacgaactagtacataaactaattactttttttgtagttcaaatattcttttttttttttagcaataatccttcttgtatct

SEQ ID NO: 285 - DNA, 200 bp, Amaranthus palmeri
agattacatatgaattctcttttgttgtttaaaaaactttgaaattgaaaattgttggctttttgttgaagaaacgatgtgtgtcagttgaaaacagaatatttaaactacaaaaaaagcaattagtatatacacaatacacttgttcatttaaacccatatagtacatttaaataattatttgaaaagggctgttaatg

SEQ ID NO: 286 - DNA, 200 bp, Amaranthus palmeri
cattaacagcccttttcaaataattatttaaatgtactatatgggtttaaatgaacaagtgtattgtgtatatactaattgctttttttgtagtttaaatattctgttttcaactgacacacatcgtttcttcaacaaaaagccaacaattttcaatttcaaagttttttaaacaacaaaagagaattcatatgtaatct

SEQ ID NO: 287 - DNA, 200 bp, Amaranthus palmeri
aattatttgaaaagggctgttaatgtgtgaagactttcgctatattgatctgattggatatgtgtaataccttgaaacgtcatgcagttggacggaaacagccatgtgatatatgccgaggaagaagctgcaggaactcgccttctgattgatggaagaacttgtttgcttcaggtaatgccgtgtgattctcttttttt

SEQ ID NO: 288 - DNA, 200 bp, Amaranthus palmeri
aaaaaaagagaatcacacggcattacctgaagcaaacaagttcttccatcaatcagaaggcgagttcctgcagcttcttcctcggcatatatcacatggctgtttccgtccaactgcatgacgtttcaaggtattacacatatccaatcagatcaatatagcgaaagtcttcacacattaacagcccttttcaaataatt

SEQ ID NO: 289 - DNA, 200 bp, Amaranthus palmeri
taatgccgtgtgattctcttttttttttttttttgtgaattctaaaccttaaaaatcattcttcaccggacatgttcatttttccatatagaacgatcacgatccttcaaagctgattgcggagactccgtgtaagcttatgcggtatttggtaccagataacagtcacatagatgcagatactccgtatgctgaagttg

SEQ ID NO: 290 - DNA, 200 bp, Amaranthus palmeri
caacttcagcatacggagtatctgcatctatgtgactgttatctggtaccaaataccgcataagcttacacggagtctccgcaatcagctttgaaggatcgtgatcgttctatatggaaaaatgaacatgtccggtgaagaatgatttttaaggtttagaattcacaaaaaaaaaaaaaaaagagaatcacacggcatta

SEQ ID NO: 291 - DNA, 200 bp, Amaranthus palmeri
gcagatactccgtatgctgaagttgaggtcatgaagatgtgtatgcctttgctttccccagcatccggtgttttacaatttaagatgtccgaaggtcaagctatgcaggtatgcatcattttaatcgtaaattcagcaacctcgtttatattggattctatatatggtcttgctgtgtaggctggtgaactcatagctag

SEQ ID NO: 292 - DNA, 200 bp, Amaranthus palmeri
ctagctatgagttcaccagcctacacagcaagaccatatatagaatccaatataaacgaggttgctgaatttacgattaaaatgatgcatacctgcatagcttgaccttcggacatcttaaattgtaaaacaccggatgctggggaaagcaaaggcatacacatcttcatgacctcaacttcagcatacggagtatctgc

SEQ ID NO: 293 - DNA, 200 bp, Amaranthus palmeri
tgtaggctggtgaactcatagctagtctagagttggatgatccttcagctgtaagaaaagccgaacctttcagtggaagctttcctgccatgggctctccaactgcaatatctggaaaagttcatcagaggtgtgccgcaagtttaaatgccgctcggatgattttggctggttatgaacacaatatagatgaagtaagt

SEQ ID NO: 294 - DNA, 200 bp, Amaranthus palmeri
acttacttcatctatattgtgttcataaccagccaaaatcatccgagcggcatttaaacttgcggcacacctctgatgaacttttccagatattgcagttggagagcccatggcaggaaagcttccactgaaaggttcggcttttcttacagctgaaggatcatccaactctagactagctatgagttcaccagcctaca

SEQ ID NO: 295 - DNA, 200 bp, Amaranthus palmeri
tgaacacaatatagatgaagtaagtttcaaaccaccatttcatttttcatcaacatagtttttaggctagcctcttaatgggttgatgccatagtgtaaaaacaaggccacatcgcatcacgtcaccgcgttgttaaggatttcaaaaacaacgaaccgatatttcccatgttgtgggccgtaccaagggatatcttatg

SEQ ID NO: 296 - DNA, 200 bp, Amaranthus palmeri
cataagatatcccttggtacggcccacaacatgggaaatatcggttcgttgtttttgaaatccttaacaacgcggtgacgtgatgcgatgtggccttgtttttacactatggcatcaacccattaagaggctagcctaaaaactatgttgatgaaaaatgaaatggtggtttgaaacttacttcatctatattgtgttca

SEQ ID NO: 297 - DNA, 200 bp, Amaranthus palmeri
gggccgtaccaagggatatcttatggttttgaccggtatttaggcgttacaataaccgcatcactcccgttaccgcatcattgttctgttacactatggatgccgaaccttgagatgcatttcccatttttcaatagagcccctagtttttttcttcctgtttggaaattttttacatgtgagccttttattttctcagg

SEQ ID NO: 298 - DNA, 200 bp, Amaranthus palmeri
cctgagaaaataaaaggctcacatgtaaaaaatttccaaacaggaagaaaaaaactaggggctctattgaaaaatgggaaatgcatctcaaggttcggcatccatagtgtaacagaacaatgatgcggtaacgggagtgatgcggttattgtaacgcctaaataccggtcaaaaccataagatatcccttggtacggccc

SEQ ID NO: 299 - DNA, 200 bp, Amaranthus palmeri
catgtgagccttttattttctcaggtagtacagagtttgctggaatgccttgatagtcccgaacttccattccttcaatggcaagaatgcttgtctgtgctggcaacacgactccccaaagatctgagatacgaagtgtgtattctatcatctgttctttatttagttatttatatttccttataataattttgaacttt

SEQ ID NO: 300 - DNA, 200 bp, Amaranthus palmeri
aaagttcaaaattattataaggaaatataaataactaaataaagaacagatgatagaatacacacttcgtatctcagatctttggggagtcgtgttgccagcacagacaagcattcttgccattgaaggaatggaagttcgggactatcaaggcattccagcaaactctgtactacctgagaaaataaaaggctcacatg

SEQ ID NO: 301 - DNA, 200 bp, Amaranthus palmeri
tttccttataataattttgaactttttcctcggagtttacagttggaatcaaaatctagagcttttgaagcgattaccaacaccccaaacgtagaatttcctgctaagttgttgaaaagtattcttgaggttagtacctcactttgttaccttctgtaaattattcattcggcgagttactcatgttagtaacatgttta

SEQ ID NO: 302 - DNA, 200 bp, Amaranthus palmeri
taaacatgttactaacatgagtaactcgccgaatgaataatttacagaaggtaacaaagtgaggtactaacctcaagaatacttttcaacaacttagcaggaaattctacgtttggggtgttggtaatcgcttcaaaagctctagattttgattccaactgtaaactccgaggaaaaagttcaaaattattataaggaaa

SEQ ID NO: 303 - DNA, 200 bp, Amaranthus palmeri
gttactcatgttagtaacatgtttattcttcgtaggaccatttaaactcatgccaagagaaagataaaggagctcaagagaggcttattgagcctcttatggttcttgtaaagtcttacgaaggtgggagagaaagtcatgctcgttttattgttcaatctttatttgaagagtatttgtccgttgaagaattgtttagc

SEQ ID NO: 304 - DNA, 200 bp, Amaranthus palmeri
gctaaacaattcttcaacggacaaatactcttcaaataaagattgaacaataaaacgagcatgactttctctcccaccttcgtaagactttacaagaaccataagaggctcaataagcctctcttgagctcctttatctttctcttggcatgagtttaaatggtcctacgaagaataaacatgttactaacatgagtaac

SEQ ID NO: 305 - DNA, 200 bp, Amaranthus palmeri
tttgtccgttgaagaattgtttagcgacaatctccaggtttgtccatctatctagagcaatttgattatgatgtttttttaaagttcataaattttagcttggtgccacaccgtcagtggctgatgatcgtcgctttgtgatcattaagcttttaaaagctgtctcctgttctccatcactatttttagaaattttgagt

SEQ ID NO: 306 - DNA, 200 bp, Amaranthus palmeri
actcaaaatttctaaaaatagtgatggagaacaggagacagcttttaaaagcttaatgatcacaaagcgacgatcatcagccactgacggtgtggcaccaagctaaaatttatgaactttaaaaaaacatcataatcaaattgctctagatagatggacaaacctggagattgtcgctaaacaattcttcaacggacaaa

SEQ ID NO: 307 - DNA, 200 bp, Amaranthus palmeri
atcactatttttagaaattttgagttctgatgtatatactcggtacccgagggactctttggccgctttcttctttatgggtatgagttgcctccttccttccctccccagatcctgatcatagtttctatgagcgggatacattgggtatgatgatgatgatgtatatactcggtgctgagccagcatatgaaaagcaa

SEQ ID NO: 308 - DNA, 200 bp, Amaranthus palmeri
ttgcttttcatatgctggctcagcaccgagtatatacatcatcatcatcatacccaatgtatcccgctcatagaaactatgatcaggatctggggagggaaggaaggaggcaactcatacccataaagaagaaagcggccaaagagtccctcgggtaccgagtatatacatcagaactcaaaatttctaaaaatagtgat

SEQ ID NO: 309 - DNA, 200 bp, Amaranthus palmeri
tgctgagccagcatatgaaaagcaaactgtcgtgaatttatcttatgtctttaaagaataccgaggcacctgattttacattttatctttatttttttctgtatgaagaaatagtaaattatattcttcaatagttgactcggagtgatgtttgtaatatgtttagaaaaaatgttggactagaaagtcagcgcagcgca

SEQ ID NO: 310 - DNA, 200 bp, Amaranthus palmeri
tgcgctgcgctgactttctagtccaacattttttctaaacatattacaaacatcactccgagtcaactattgaagaatataatttactatttcttcatacagaaaaaaataaagataaaatgtaaaatcaggtgcctcggtattctttaaagacataagataaattcacgacagtttgcttttcatatgctggctcagca

SEQ ID NO: 311 - DNA, 200 bp, Amaranthus palmeri
tggactagaaagtcagcgcagcgcatatattagtttatgattgtggctttaatcagtttatgcttttgatgttaatctttccaggctgatgtgattgaacgtctccgccttcagtataagaaggatctgctgaagattgttgacattgtactgtcgcatcaggtacgtattcttgatttactgttgttccttttgttctc

SEQ ID NO: 312 - DNA, 200 bp, Amaranthus palmeri
gagaacaaaaggaacaacagtaaatcaagaatacgtacctgatgcgacagtacaatgtcaacaatcttcagcagatccttcttatactgaaggcggagacgttcaatcacatcagcctggaaagattaacatcaaaagcataaactgattaaagccacaatcataaactaatatatgcgctgcgctgactttctagtcca

SEQ ID NO: 313 - DNA, 200 bp, Amaranthus palmeri
atttactgttgttccttttgttctcttcggcatttctatttttttttaatatattttatggttttcagggtgttaagaataaaaataagctgattctacgactcatggaacagctggtttacccaaatcccgctgcatacagggggcaacttatccgtttctctcaattgaaccatacaatgtattctgaggttggtgat

SEQ ID NO: 314 - DNA, 200 bp, Amaranthus palmeri
atcaccaacctcagaatacattgtatggttcaattgagagaaacggataagttgccccctgtatgcagcgggatttgggtaaaccagctgttccatgagtcgtagaatcagcttatttttattcttaacaccctgaaaaccataaaatatattaaaaaaaaatagaaatgccgaagagaacaaaaggaacaacagtaaat

SEQ ID NO: 315 - DNA, 200 bp, Amaranthus palmeri
tacaatgtattctgaggttggtgatcctcaaacacccaaagctatgtatttctcataatgcttaagtagagtaataattaataattgtccaatgattgcagttggcactaaaggccagtcaattgcttgaacaaacgaaattgagtgagctccgttcgaacattgctagaaacctctctgagctagaaatgtttaccgag

SEQ ID NO: 316 - DNA, 200 bp, Amaranthus palmeri
ctcggtaaacatttctagctcagagaggtttctagcaatgttcgaacggagctcactcaatttcgtttgttcaagcaattgactggcctttagtgccaactgcaatcattggacaattattaattattactctacttaagcattatgagaaatacatagctttgggtgtttgaggatcaccaacctcagaatacattgta

SEQ ID NO: 317 - DNA, 200 bp, Amaranthus palmeri
ctctgagctagaaatgtttaccgaggatggtgaaaacatggatactccaaaaagaaaaagtgctattaatgaacgtatggaggcccttgtgagtactcctctagctgttgaagatgcccttgttggtttgtttgatcatagtgatcatacacttcagaggcgggttgttgagacctatgttcggaggctttatcaggtga

SEQ ID NO: 318 - DNA, 200 bp, Amaranthus palmeri
tcacctgataaagcctccgaacataggtctcaacaacccgcctctgaagtgtatgatcactatgatcaaacaaaccaacaagggcatcttcaacagctagaggagtactcacaagggcctccatacgttcattaatagcactttttctttttggagtatccatgttttcaccatcctcggtaaacatttctagctcagag

SEQ ID NO: 319 - DNA, 200 bp, Amaranthus palmeri
tatgttcggaggctttatcaggtgaatacatactttaaatgcggactcggtcctattcattgtagaaacttctcttgatctttctcgagtcgggggactctttggccgcactctcctttatgggtatgagttgccgccttccttccctccccagaccctgcacatagtttttctatgggaaggatactctgggtatgatg

SEQ ID NO: 320 - DNA, 200 bp, Amaranthus palmeri
catcatacccagagtatccttcccatagaaaaactatgtgcagggtctggggagggaaggaaggcggcaactcatacccataaaggagagtgcggccaaagagtcccccgactcgagaaagatcaagagaagtttctacaatgaataggaccgagtccgcatttaaagtatgtattcacctgataaagcctccgaacata

SEQ ID NO: 321 - DNA, 200 bp, Amaranthus palmeri
tgggaaggatactctgggtatgatgatgatgattattattatcgctacttgaacaatttttcttatgttatttaactccttttttgtttttggcaaccgctttctcagccttatcttgtcaagggaagtgtcaggatgctgtggcacagatcaggtttcatagctttatgggaatttgttgaggagaatattgaccgaac

SEQ ID NO: 322 - DNA, 200 bp, Amaranthus palmeri
gttcggtcaatattctcctcaacaaattcccataaagctatgaaacctgatctgtgccacagcatcctgacacttcccttgacaagataaggctgagaaagcggttgccaaaaacaaaaaaggagttaaataacataagaaaaattgttcaagtagcgataataataatcatcatcatcatacccagagtatccttccca

SEQ ID NO: 323 - DNA, 200 bp, Amaranthus palmeri
ttgttgaggagaatattgaccgaacaaatttttctgatgatctgactacaaacagtgggaaccatagtgagcgaaagtggggggccatggtcgttattaaaactcttcagttcttgccatcggtgattgctgcagcattgagagaaacaactcatagttccgatcaatcaacttccactggctctatagaatcagtcatc

SEQ ID NO: 324 - DNA, 200 bp, Amaranthus palmeri
gatgactgattctatagagccagtggaagttgattgatcggaactatgagttgtttctctcaatgctgcagcaatcaccgatggcaagaactgaagagttttaataacgaccatggccccccactttcgctcactatggttcccactgtttgtagtcagatcatcagaaaaatttgttcggtcaatattctcctcaacaa

SEQ ID NO: 325 - DNA, 200 bp, Amaranthus palmeri
cactggctctatagaatcagtcatccatggaaatatgctgcacattgcactagtgggggtgaacaaccagatgagcttgttgcaggataggtaaataagactagcctgtaacatatggtgtaataatctttattatgtaaccttgtgcttctaatgtcctttagttctatggactatattaaagtacacttcttgttcat

SEQ ID NO: 326 - DNA, 200 bp, Amaranthus palmeri
atgaacaagaagtgtactttaatatagtccatagaactaaaggacattagaagcacaaggttacataataaagattattacaccatatgttacaggctagtcttatttacctatcctgcaacaagctcatctggttgttcacccccactagtgcaatgtgcagcatatttccatggatgactgattctatagagccagtg

SEQ ID NO: 327 - DNA, 200 bp, Amaranthus palmeri
atattaaagtacacttcttgttcatgtgatgttgatgttgataattgctatcgggtcaatcacaaacaacctctttgttatcacttgaggtgttcaaaatagacccgatgactcgatattcatcagatcttgtaactgaactcgacttcaaaatgaatttaaaattatataaaaatcaatatggacacaagaccggatat

SEQ ID NO: 328 - DNA, 200 bp, Amaranthus palmeri
atatccggtcttgtgtccatattgatttttatataattttaaattcattttgaagtcgagttcagttacaagatctgatgaatatcgagtcatcgggtctattttgaacacctcaagtgataacaaagaggttgtttgtgattgacccgatagcaattatcaacatcaacatcacatgaacaagaagtgtactttaatat

SEQ ID NO: 329 - DNA, 200 bp, Amaranthus palmeri
tcaatatggacacaagaccggatatcaatccgacccgaaatagttgactcgaaatcaacttgatgatccgaatgaacacctctagttatcactaacaagggtcagattgcgtacatcaaacccctcaaatcctgcttaggtgggagcttgtcaatggcttaggggtaacgggaatgtgtgtgctatgtacattgtgcatc

SEQ ID NO: 330 - DNA, 200 bp, Amaranthus palmeri
gatgcacaatgtacatagcacacacattcccgttacccctaagccattgacaagctcccacctaagcaggatttgaggggtttgatgtacgcaatctgacccttgttagtgataactagaggtgttcattcggatcatcaagttgatttcgagtcaactatttcgggtcggattgatatccggtcttgtgtccatattga

SEQ ID NO: 331 - DNA, 200 bp, Amaranthus palmeri
gtgtgtgctatgtacattgtgcatctattcttatacttatgttgagttttttggatcaaatataaagaacttaacttttgtattttcttgatgtggtgtagtggtgatgaagatcaggctcaagagagaatccataaattggccaaaattctgagagagcaagaagtgagttcagcccttcgtgctgctggtgttggtgt

SEQ ID NO: 332 - DNA, 200 bp, Amaranthus palmeri
acaccaacaccagcagcacgaagggctgaactcacttcttgctctctcagaattttggccaatttatggattctctcttgagcctgatcttcatcaccactacaccacatcaagaaaatacaaaagttaagttctttatatttgatccaaaaaactcaacataagtataagaatagatgcacaatgtacatagcacacac

SEQ ID NO: 333 - DNA, 200 bp, Amaranthus palmeri
cccttcgtgctgctggtgttggtgtgattagttgcatcatacagagagatgaagggcgaactccgatgaggcattcattctattggtcagcagaaaaacaatattatagtgaggagcctttactacgtcatttggaaccccctctatctatgtatctcgagctggtactagtctctgaaccgattgcctttcttctgctt

SEQ ID NO: 334 - DNA, 200 bp, Amaranthus palmeri
aagcagaagaaaggcaatcggttcagagactagtaccagctcgagatacatagatagagggggttccaaatgacgtagtaaaggctcctcactataatattgtttttctgctgaccaatagaatgaatgcctcatcggagttcgcccttcatctctctgtatgatgcaactaatcacaccaacaccagcagcacgaaggg

SEQ ID NO: 335 - DNA, 200 bp, Amaranthus palmeri
tgaaccgattgcctttcttctgctttgttattctgtgtgatatttcgacttaagtctaatttacatcgttttgtacatttgttatccaaagcacgttaaaagatacttccttcgtttttttacaagcacccaaacacctttttacgcagcccaattggtttgtcgggttgcttatatatagaattatactcaacttaaaa

SEQ ID NO: 336 - DNA, 200 bp, Amaranthus palmeri
ttttaagttgagtataattctatatataagcaacccgacaaaccaattgggctgcgtaaaaaggtgtttgggtgcttgtaaaaaaacgaaggaagtatcttttaacgtgctttggataacaaatgtacaaaacgatgtaaattagacttaagtcgaaatatcacacagaataacaaagcagaagaaaggcaatcggttca

SEQ ID NO: 337 - DNA, 200 bp, Amaranthus palmeri
atatagaattatactcaacttaaaaattataaaatttgatattatgaaagtattcgacgtgacgaattaaacaaaatcccatatgactatgtttttttctcgtttaatagctgtaatatgtaaaatactatcgaatgatgaatagtgtaaaaactggtttgggtgcaactaaaaaaatggaggaagtataattatgcagc

SEQ ID NO: 338 - DNA, 200 bp, Amaranthus palmeri
gctgcataattatacttcctccatttttttagttgcacccaaaccagtttttacactattcatcattcgatagtattttacatattacagctattaaacgagaaaaaaacatagtcatatgggattttgtttaattcgtcacgtcgaatactttcataatatcaaattttataatttttaagttgagtataattctatat

SEQ ID NO: 339 - DNA, 200 bp, Amaranthus palmeri
aatggaggaagtataattatgcagccaaaattgatggcttttaacttttcatcaaatcaggacaagcttaagggttatgaagatatcaaatatactccttcccgtgatcgtcaatggcatctttacacagttattgataaaccattcattcggaggatgtttttgagaacccttgtaagacaacccatctctgagttcac

SEQ ID NO: 340 - DNA, 200 bp, Amaranthus palmeri
gtgaactcagagatgggttgtcttacaagggttctcaaaaacatcctccgaatgaatggtttatcaataactgtgtaaagatgccattgacgatcacgggaaggagtatatttgatatcttcataacccttaagcttgtcctgatttgatgaaaagttaaaagccatcaattttggctgcataattatacttcctccatt

SEQ ID NO: 341 - DNA, 200 bp, Amaranthus palmeri
taagacaacccatctctgagttcacaggcgtcgaactaagcgctcttgaaacacaaaagcctatctcttttacttcaagaagcatcctaaggtccttaacaaccgccatggaggagttggagctcaatgcacatagtgcttcactgaaacccgatcacgctcatatgtacttgtacattgttcgagagcaacaaatatac

SEQ ID NO: 342 - DNA, 200 bp, Amaranthus palmeri
gtatatttgttgctctcgaacaatgtacaagtacatatgagcgtgatcgggtttcagtgaagcactatgtgcattgagctccaactcctccatggcggttgttaaggaccttaggatgcttcttgaagtaaaagagataggcttttgtgtttcaagagcgcttagttcgacgcctgtgaactcagagatgggttgtctta

SEQ ID NO: 343 - DNA, 200 bp, Amaranthus palmeri
cattgttcgagagcaacaaatatacgatcttgtgccatatcacaggtatctattgctgcgtgcctcatttttttttttgtttattattggtcattagtacaccttattcttagaagaaacttttttcggccaattatttccagggaggtgaacatagatcaccaacaagaagaggcttcggttcaattctttttggaaga

SEQ ID NO: 344 - DNA, 200 bp, Amaranthus palmeri
tcttccaaaaagaattgaaccgaagcctcttcttgttggtgatctatgttcacctccctggaaataattggccgaaaaaagtttcttctaagaataaggtgtactaatgaccaataataaacaaaaaaaaaaatgaggcacgcagcaatagatacctgtgatatggcacaagatcgtatatttgttgctctcgaacaatg

SEQ ID NO: 345 - DNA, 200 bp, Amaranthus palmeri
cttcggttcaattctttttggaagatctcgcgcatgaaatccatagtcttgctggtgtaaggatgcataaactaaatgtttgtgagtgggaagtgaaacttcgggtatcttctcccgggaaagctaatggtttatggagggtggcagttactaatgtgactggtcatacctgttcggtacatgtaagtcataagtttgag

SEQ ID NO: 346 - DNA, 200 bp, Amaranthus palmeri
ctcaaacttatgacttacatgtaccgaacaggtatgaccagtcacattagtaactgccaccctccataaaccattagctttcccgggagaagatacccgaagtttcacttcccactcacaaacatttagtttatgcatccttacaccagcaagactatggatttcatgcgcgagatcttccaaaaagaattgaaccgaag

SEQ ID NO: 347 - DNA, 200 bp, Amaranthus palmeri
ggtacatgtaagtcataagtttgagaacctcttttttgatctagtcacaattttgatttttcacaaattcttgtatgagacggtctcaccgtgagaatcaccccatacttggattaaatagccgaataatagaaacttttagcataatggaccttttgtatgaactcgtctcacggagagaaggtctcatacaatagggg

SEQ ID NO: 348 - DNA, 200 bp, Amaranthus palmeri
cccctattgtatgagaccttctctccgtgagacgagttcatacaaaaggtccattatgctaaaagtttctattattcggctatttaatccaagtatggggtgattctcacggtgagaccgtctcatacaagaatttgtgaaaaatcaaaattgtgactagatcaaaaaagaggttctcaaacttatgacttacatgtacc

SEQ ID NO: 349 - DNA, 200 bp, Amaranthus palmeri
gagagaaggtctcatacaataggggcaattaatttttagctttttatcggtaaattttgcatagtacatagttttgaattttgagaggttgagtctatgtgacaacgaatatttaattgagtataatgttgtttaatccaaatatgatataaaagggtgtggcatatgtgattgagcattcttttttcttttctatggga

SEQ ID NO: 350 - DNA, 200 bp, Amaranthus palmeri
tcccatagaaaagaaaaaagaatgctcaatcacatatgccacacccttttatatcatatttggattaaacaacattatactcaattaaatattcgttgtcacatagactcaacctctcaaaattcaaaactatgtactatgcaaaatttaccgataaaaagctaaaaattaattgcccctattgtatgagaccttctctc

SEQ ID NO: 351 - DNA, 200 bp, Amaranthus palmeri
gcattcttttttcttttctatgggaagttaaaggtctaaaccttggtataatttccttcaatgatgagcaatcaaagggtttcagacctgtttatttatgactcgaaagtcgaacccaaaccagaacccgaacccgactcaacttgatttttttgacatgcctaaatggaactacagatgtattggggaaaataattaaa

SEQ ID NO: 352 - DNA, 200 bp, Amaranthus palmeri
tttaattattttccccaatacatctgtagttccatttaggcatgtcaaaaaaatcaagttgagtcgggttcgggttctggtttgggttcgactttcgagtcataaataaacaggtctgaaaccctttgattgctcatcattgaaggaaattataccaaggtttagacctttaacttcccatagaaaagaaaaaagaatgc

SEQ ID NO: 353 - DNA, 200 bp, Amaranthus palmeri
agatgtattggggaaaataattaaactagaaaatggggaaaataattaaactagaaaatggggaaaacaatttacctagaatatgttttcagccaaaacaaacactcccaaatacatttcttagcatccacaaatgccgaggaattgcaatggaactccagttcctcggttcttcaacgtagagacgtatataattcttt

SEQ ID NO: 354 - DNA, 200 bp, Amaranthus palmeri
aaagaattatatacgtctctacgttgaagaaccgaggaactggagttccattgcaattcctcggcatttgtggatgctaagaaatgtatttgggagtgtttgttttggctgaaaacatattctaggtaaattgttttccccattttctagtttaattattttccccattttctagtttaattattttccccaatacatct

SEQ ID NO: 355 - DNA, 200 bp, Amaranthus palmeri
aacgtagagacgtatataattcttttttgcacgatatcattaaggttaattgacctgttttttctatgaaatataatttaatttttatgctctttagtttgttttactacacatgaatagttttggttttgagtgatcattttcttacattattgatgcccaggtttatcgtgaattggaagatagcaaccttcatgaaa

SEQ ID NO: 356 - DNA, 200 bp, Amaranthus palmeri
tttcatgaaggttgctatcttccaattcacgataaacctgggcatcaataatgtaagaaaatgatcactcaaaaccaaaactattcatgtgtagtaaaacaaactaaagagcataaaaattaaattatatttcatagaaaaaacaggtcaattaaccttaatgatatcgtgcaaaaaagaattatatacgtctctacgtt

SEQ ID NO: 357 - DNA, 200 bp, Amaranthus palmeri
ttggaagatagcaaccttcatgaaatggtctaccattcagtatctgttcacggcccccaccatggggtacctgtgaatgcaccctatcaaccactcggtggcatcgcccgtaagcgacttcaggccatgaaaagtagcacaacttactgttacgattttccactggtacggaatttgaaaatttcatcactccctccccc

SEQ ID NO: 358 - DNA, 200 bp, Amaranthus palmeri
gggggagggagtgatgaaattttcaaattccgtaccagtggaaaatcgtaacagtaagttgtgctacttttcatggcctgaagtcgcttacgggcgatgccaccgagtggttgatagggtgcattcacaggtaccccatggtgggggccgtgaacagatactgaatggtagaccatttcatgaaggttgctatcttccaa

SEQ ID NO: 359 - DNA, 200 bp, Amaranthus palmeri
tgaaaatttcatcactccctcccccgtcttccccttaatatactttgtcgcccgttatttcatattccgttttatcaaccatgcaaggatcttccagggttccgaatttcattttttcgtacttccaaagtttcaggcaaacttactttttttgacgctgttgttttcaggctttctcaactgccctgaagcaatcatgg

SEQ ID NO: 360 - DNA, 200 bp, Amaranthus palmeri
ccatgattgcttcagggcagttgagaaagcctgaaaacaacagcgtcaaaaaaagtaagtttgcctgaaactttggaagtacgaaaaaatgaaattcggaaccctggaagatccttgcatggttgataaaacggaatatgaaataacgggcgacaaagtatattaaggggaagacgggggagggagtgatgaaattttca

SEQ ID NO: 361 - DNA, 200 bp, Amaranthus palmeri
ctcaactgccctgaagcaatcatgggcatcggaagctccggatgtcaagaaaccctcggacaaagcgcttttgaaagtaacggagttagcgtttgctgatccaaaaggcacatggggaactccgcttgttccaataaatcgcaagcctggtatgaacgatgttggcatggtagcctggtacatggaaatgtccacccccg

SEQ ID NO: 362 - DNA, 200 bp, Amaranthus palmeri
cgggggtggacatttccatgtaccaggctaccatgccaacatcgttcataccaggcttgcgatttattggaacaagcggagttccccatgtgccttttggatcagcaaacgctaactccgttactttcaaaagcgctttgtccgagggtttcttgacatccggagcttccgatgcccatgattgcttcagggcagttgag

SEQ ID NO: 363 - DNA, 200 bp, Amaranthus palmeri
tggtacatggaaatgtccacccccgagttccctaatggaagaacaataatggttgtagctaatgatgttaccttcaaggccggatcttttggaccacgagaagatgctttcttccttgctgttacaaatcttgcttgcgcgaagaaacttcctcttatttatctggctgccaattcaggagctcgacttggtgttgccga

SEQ ID NO: 364 - DNA, 200 bp, Amaranthus palmeri
tcggcaacaccaagtcgagctcctgaattggcagccagataaataagaggaagtttcttcgcgcaagcaagatttgtaacagcaaggaagaaagcatcttctcgtggtccaaaagatccggccttgaaggtaacatcattagctacaaccattattgttcttccattagggaactcgggggtggacatttccatgtacca

SEQ ID NO: 365 - DNA, 200 bp, Amaranthus palmeri
caggagctcgacttggtgttgccgaagagctaaaatcctgctttaaagttggctggtcggatgagtcaaatcccgagagtggatttcagtatgtctacttaacccctgaagattacgatcgtataggatcgtcagtcatagcccacgagttaaaactcgaaagtggagaaaaaagatgggttatagataccgttgtaggt

SEQ ID NO: 366 - DNA, 200 bp, Amaranthus palmeri
acctacaacggtatctataacccatcttttttctccactttcgagttttaactcgtgggctatgactgacgatcctatacgatcgtaatcttcaggggttaagtagacatactgaaatccactctcgggatttgactcatccgaccagccaactttaaagcaggattttagctcttcggcaacaccaagtcgagctcctg

SEQ ID NO: 367 - DNA, 200 bp, Amaranthus palmeri
atgggttatagataccgttgtaggtaaggaggacggattaggtgttgagaacctatcgggaagtggtgctatagccagtgcatactcaagggcttacaaggaaacatttactctgacttttgtaaccggaagaacggtcggtattggtgcctatcttgctcgtcttgggatgcgttgtatacagaggcttgaccagccta

SEQ ID NO: 368 - DNA, 200 bp, Amaranthus palmeri
taggctggtcaagcctctgtatacaacgcatcccaagacgagcaagataggcaccaataccgaccgttcttccggttacaaaagtcagagtaaatgtttccttgtaagcccttgagtatgcactggctatagcaccacttcccgataggttctcaacacctaatccgtcctccttacctacaacggtatctataacccat

SEQ ID NO: 369 - DNA, 200 bp, Amaranthus palmeri
tgtatacagaggcttgaccagcctataattctcacgggtttttctgcgttaaataaacttctcggtcgggaggtttatagttcacacatgcaacttggtggaccgaagattatgggcacaaacggggtagttcatcttacagtatccgatgatcttgaaggcatttcatctatcttgaagtggctgagctacgttccacc

SEQ ID NO: 370 - DNA, 200 bp, Amaranthus palmeri
ggtggaacgtagctcagccacttcaagatagatgaaatgccttcaagatcatcggatactgtaagatgaactaccccgtttgtgcccataatcttcggtccaccaagttgcatgtgtgaactataaacctcccgaccgagaagtttatttaacgcagaaaaacccgtgagaattataggctggtcaagcctctgtataca

SEQ ID NO: 371 - DNA, 200 bp, Amaranthus palmeri
tgaagtggctgagctacgttccaccctattcaggtggtgaacttccgatttctcggtgtttagaccctccaggaagaccggttgcgtatttgcctgaaaattcttgtgatcctcgtggtgctatatctggtacggttgactccaccggtaaatggtttgggggtattttcgacaaggatagttttgtggaaaccttagaa

SEQ ID NO: 372 - DNA, 200 bp, Amaranthus palmeri
ttctaaggtttccacaaaactatccttgtcgaaaatacccccaaaccatttaccggtggagtcaaccgtaccagatatagcaccacgaggatcacaagaattttcaggcaaatacgcaaccggtcttcctggagggtctaaacaccgagaaatcggaagttcaccacctgaatagggtggaacgtagctcagccacttca

SEQ ID NO: 373 - DNA, 200 bp, Amaranthus palmeri
ggatagttttgtggaaaccttagaaggatgggcacaaacagttgtcacgggaagggctaaactcggaggaattccagttggcatagttgccgttgagacgcagactgttatgcaagtaatcccagcagatcccggtcaactcgactcacacgagagagtcgtaccacaagcagggcaagtatggttcccagattccgcat

SEQ ID NO: 374 - DNA, 200 bp, Amaranthus palmeri
atgcggaatctgggaaccatacttgccctgcttgtggtacgactctctcgtgtgagtcgagttgaccgggatctgctgggattacttgcataacagtctgcgtctcaacggcaactatgccaactggaattcctccgagtttagcccttcccgtgacaactgtttgtgcccatccttctaaggtttccacaaaactatcc

SEQ ID NO: 375 - DNA, 200 bp, Amaranthus palmeri
caagtatggttcccagattccgcatccaagacagcacaagcgctgatggatttcaaccgggaagaactcccacttttcattctagctaattggagaggtttctcgggtggacaaagggatctctttgaagggatccttcaggccggatccaccatagttgaaaatcttaggacttataatcaacccgtttttgtttatat

SEQ ID NO: 376 - DNA, 200 bp, Amaranthus palmeri
atataaacaaaaacgggttgattataagtcctaagattttcaactatggtggatccggcctgaaggatcccttcaaagagatccctttgtccacccgagaaacctctccaattagctagaatgaaaagtgggagttcttcccggttgaaatccatcagcgcttgtgctgtcttggatgcggaatctgggaaccatacttg

SEQ ID NO: 377 - DNA, 200 bp, Amaranthus palmeri
ataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgattgagattaagttccgaaccaaggaacttctcgagtgtatgggaaggctt

SEQ ID NO: 378 - DNA, 200 bp, Amaranthus palmeri
aagccttcccatacactcgagaagttccttggttcggaacttaatctcaatcattccttccggttcaagcacatttcctttagctgtttggtcggcgtacatttctatatggtcggaattaattcgactatcgacgaccacccatgcgcctcctcgaagctcccccatcatagggatataaacaaaaacgggttgattat

SEQ ID NO: 379 - DNA, 200 bp, Amaranthus palmeri
acttctcgagtgtatgggaaggcttgatcaacaactcatcggtctcaaggaaaaactagccgaagccaagagctctaattcctacaataaaatcgagcccctgcagcaacaaataaaagcccgtgagaagcaactattgcctctatatactcaaatagccaccaaatttgccgagttgcacgatacgtctttaaggatgg

SEQ ID NO: 380 - DNA, 200 bp, Amaranthus palmeri
ccatccttaaagacgtatcgtgcaactcggcaaatttggtggctatttgagtatatagaggcaatagttgcttctcacgggcttttatttgttgctgcaggggctcgattttattgtaggaattagagctcttggcttcggctagtttttccttgagaccgatgagttgttgatcaagccttcccatacactcgagaagt

SEQ ID NO: 381 - DNA, 200 bp, Amaranthus palmeri
ttgcacgatacgtctttaaggatggctgccaaaggagtcattagggacgtcttggaatggaaaagctcgcgttcgttcttttacaaaagattatacaggagagttatggaggaatcactcgtcaagactgttcgagatgctgcaggtgaacggttgacccataagtcggctttggagttgatccaaaaatggttcaatga

SEQ ID NO: 382 - DNA, 200 bp, Amaranthus palmeri
tcattgaaccatttttggatcaactccaaagccgacttatgggtcaaccgttcacctgcagcatctcgaacagtcttgacgagtgattcctccataactctcctgtataatcttttgtaaaagaacgaacgcgagcttttccattccaagacgtccctaatgactcctttggcagccatccttaaagacgtatcgtgcaa

SEQ ID NO: 383 - DNA, 200 bp, Amaranthus palmeri
agttgatccaaaaatggttcaatgagtcgaatatttccggagaggcttccgatgcttgggctgatgatgcggccttctttaagtggaaggacaataccgccaactacgaggagaagttgaaagagttgcgcgttcagaaggtattggatcagctgtcgaatattggagattcggcaactaatttgagggctctgcctcag

SEQ ID NO: 384 - DNA, 200 bp, Amaranthus palmeri
ctgaggcagagccctcaaattagttgccgaatctccaatattcgacagctgatccaataccttctgaacgcgcaactctttcaacttctcctcgtagttggcggtattgtccttccacttaaagaaggccgcatcatcagcccaagcatcggaagcctctccggaaatattcgactcattgaaccatttttggatcaact

SEQ ID NO: 385 - DNA, 200 bp, Amaranthus palmeri
aactaatttgagggctctgcctcagggtcttgctgccctacttcaaaaggtaatctgatttattttatgtacattctttgttctttctcgtttgggttggatgtcgcttttgtaacgggtcgggtcggatcaatattttaatgggccgggtcaagtcatgtcaaattaaattgggcttatgggctttttgttttgaggtt

SEQ ID NO: 386 - DNA, 200 bp, Amaranthus palmeri
aacctcaaaacaaaaagcccataagcccaatttaatttgacatgacttgacccggcccattaaaatattgatccgacccgacccgttacaaaagcgacatccaacccaaacgagaaagaacaaagaatgtacataaaataaatcagattaccttttgaagtagggcagcaagaccctgaggcagagccctcaaattagtt

SEQ ID NO: 387 - DNA, 200 bp, Amaranthus palmeri
cttatgggctttttgttttgaggttgtctcaccgtgagacggtctcatacaagacgggcagaaatctaaaacaaaaagtggtaaaaggccctttaatgttctgacctgttattgacctgacccaccgatgacccattaaaatgtaaccagactcttgacccgtcgggtcaacccaccctgttaaactccttattctaatt

SEQ ID NO: 388 - DNA, 200 bp, Amaranthus palmeri
aattagaataaggagtttaacagggtgggttgacccgacgggtcaagagtctggttacattttaatgggtcatcggtgggtcaggtcaataacaggtcagaacattaaagggccttttaccactttttgttttagatttctgcccgtcttgtatgagaccgtctcacggtgagacaacctcaaaacaaaaagcccataag

SEQ ID NO: 389 - DNA, 200 bp, Amaranthus palmeri
ccctgttaaactccttattctaattgcacacaaaatctttgggagatgttttgatatcacacctcaaaaaaactcggaaaaactcctattaattcctacgataaacatacatcctcgatgccatgtatatttttcgatatctacttgtttttctattgacattttgctacggagaagtgacgttttagattgaacgcagg

SEQ ID NO: 390 - DNA, 200 bp, Amaranthus palmeri
cctgcgttcaatctaaaacgtcacttctccgtagcaaaatgtcaatagaaaaacaagtagatatcgaaaaatatacatggcatcgaggatgtatgtttatcgtaggaattaataggagtttttccgagtttttttgaggtgtgatatcaaaacatctcccaaagattttgtgtgcaattagaataaggagtttaacaggg

SEQ ID NO: 391 - DNA, 200 bp, Amaranthus palmeri
agtgacgttttagattgaacgcaggtggatccatcgagtcgagaagaactagtcgaggaactccgaaaagtgctcacttgatttcgcaaccgttgatggtcaagtgaaaccttcttggtttcatcatggtagaaaatattattaggcaaatctataattctagttacatccattgttttagacaatagtattgaactaat

SEQ ID NO: 392 - DNA, 200 bp, Amaranthus palmeri
attagttcaatactattgtctaaaacaatggatgtaactagaattatagatttgcctaataatattttctaccatgatgaaaccaagaaggtttcacttgaccatcaacggttgcgaaatcaagtgagcacttttcggagttcctcgactagttcttctcgactcgatggatccacctgcgttcaatctaaaacgtcact

SEQ ID NO: 393 - DNA, 200 bp, Amaranthus palmeri
ttttagacaatagtattgaactaatttatttaattaaattgtataaataggagaccttgaattcatttgaattaagtggcttatgcttgcattattttgtattgaatcaaataattatttacatacttttgattattaataatggtaaatcctcaaaatttgagggatttgttcctacaatgaaatcaaggacaaaatgt

SEQ ID NO: 394 - DNA, 200 bp, Amaranthus palmeri
acattttgtccttgatttcattgtaggaacaaatccctcaaattttgaggatttaccattattaataatcaaaagtatgtaaataattatttgattcaatacaaaataatgcaagcataagccacttaattcaaatgaattcaaggtctcctatttatacaatttaattaaataaattagttcaatactattgtctaaaa

SEQ ID NO: 395 - DNA, 200 bp, Amaranthus palmeri
aaatcattcccattaccgccatttagtaccactaaccaaacgggacggtaaagttttgcttactacaatatcttcttagctcataagctcagaaccttacttgaattttgacaatgtgtgtctagctatactttcaataagtatttaagaattcattttctttttatctatgtaaagttgcatatgatgtttgttataaa

SEQ ID NO: 396 - DNA, 200 bp, Amaranthus palmeri
tttataacaaacatcatatgcaactttacatagataaaaagaaaatgaattcttaaatacttattgaaagtatagctagacacacattgtcaaaattcaagtaaggttctgagcttatgagctaagaagatattgtagtaagcaaaactttaccgtcccgtttggttagtggtactaaatggcggtaatgggaatgattt

SEQ ID NO: 397 - DNA, 200 bp, Amaranthus palmeri
agttgcatatgatgtttgttataaagggtcaatcaaaaaactatctctttgttattagtaacaagggtaactgggtaaggttatgtacatccaatccctccaaaccctttttgggtgggagctacttaatggcgctgggacaatggaagtttttgtttgtcgaattcaagcggggaagtttgtttagaatgaatgttatt

SEQ ID NO: 398 - DNA, 200 bp, Amaranthus palmeri
aataacattcattctaaacaaacttccccgcttgaattcgacaaacaaaaacttccattgtcccagcgccattaagtagctcccacccaaaaagggtttggagggattggatgtacataaccttacccagttacccttgttactaataacaaagagatagttttttgattgaccctttataacaaacatcatatgcaact

SEQ ID NO: 399 - DNA, 200 bp, Amaranthus palmeri
aagtttgtttagaatgaatgttatttctaaaaatagatggtataagtatgttaatcaacaattaataatagagaactgttttattggtgtgataaacagtttcaggagcagtggtctcattttcgagcaatacaaaaagtgccgtgcttctctaaacaacgacgattcagacatgtcttctccttcccacaataatgaaa

SEQ ID NO: 400 - DNA, 200 bp, Amaranthus palmeri
tttcattattgtgggaaggagaagacatgtctgaatcgtcgttgtttagagaagcacggcactttttgtattgctcgaaaatgagaccactgctcctgaaactgtttatcacaccaataaaacagttctctattattaattgttgattaacatacttataccatctatttttagaaataacattcattctaaacaaactt

SEQ ID NO: 401 - DNA, 200 bp, Amaranthus palmeri
tcttctccttcccacaataatgaaaacccgaacggaccgatgatgccactcctgaggaattcatctgtagtatccattgttgataagttctgttatgctcttggagggacgcggccaatccatagtattttgatagcaaacaatgggatggctgctgtcaaatttataagaagtatccgaacatgggcttacgagacttt

SEQ ID NO: 402 - DNA, 200 bp, Amaranthus palmeri
aaagtctcgtaagcccatgttcggatacttcttataaatttgacagcagccatcccattgtttgctatcaaaatactatggattggccgcgtccctccaagagcataacagaacttatcaacaatggatactacagatgaattcctcaggagtggcatcatcggtccgttcgggttttcattattgtgggaaggagaaga

SEQ ID NO: 403 - DNA, 200 bp, Amaranthus palmeri
tccgaacatgggcttacgagacttttggtactgagaaggctatattattggtagccatggctactcccgaagacatgaaaatcaatgccgagcatattcgaatggctgatcagtttgttgaagtccccggaggaactaacaacaataactacgccaatgtgcagctcattgttgaggtaatgtatcttgagattagaaat

SEQ ID NO: 404 - DNA, 200 bp, Amaranthus palmeri
atttctaatctcaagatacattacctcaacaatgagctgcacattggcgtagttattgttgttagttcctccggggacttcaacaaactgatcagccattcgaatatgctcggcattgattttcatgtcttcgggagtagccatggctaccaataatatagccttctcagtaccaaaagtctcgtaagcccatgttcgga

SEQ ID NO: 405 - DNA, 200 bp, Amaranthus palmeri
ggtaatgtatcttgagattagaaatttctagcctgtcatccatagttacatggaatgtggaacatagccacgttccgcgattcgggaacattcattcccaatcaccatgaaacccgacctaaatcgctaaaggtgacgtcccggtgtagaacaccttttttttaaaatgtatttttggccttcatttacaaattgaagaa

SEQ ID NO: 406 - DNA, 200 bp, Amaranthus palmeri
ttcttcaatttgtaaatgaaggccaaaaatacattttaaaaaaaaggtgttctacaccgggacgtcacctttagcgatttaggtcgggtttcatggtgattgggaatgaatgttcccgaatcgcggaacgtggctatgttccacattccatgtaactatggatgacaggctagaaatttctaatctcaagatacattacc

SEQ ID NO: 407 - DNA, 200 bp, Amaranthus palmeri
tggccttcatttacaaattgaagaaaggaggaaaaaacaagatgtaacccagaaacctaaacaaatccacttgaaaataatttcttaaagcaaattaatcattttagtttaattttgtttcaaatatatattttatacataatgtatctcatacccaatcgttcttgagtaaatctaggttgcgttctgtgttcccattc

SEQ ID NO: 408 - DNA, 200 bp, Amaranthus palmeri
gaatgggaacacagaacgcaacctagatttactcaagaacgattgggtatgagatacattatgtataaaatatatatttgaaacaaaattaaactaaaatgattaatttgctttaagaaattattttcaagtggatttgtttaggtttctgggttacatcttgttttttcctcctttcttcaatttgtaaatgaaggcca

SEQ ID NO: 409 - DNA, 200 bp, Amaranthus palmeri
taggttgcgttctgtgttcccattcttgtttcctgttcgaaaccaaatgtcgttcagttaacaatgctgttatctgctttactgtgatttattaaatgtgtccttcgaaaaaaggcaatatcagagcgacttgatgcagtatggcctggccggggacatgcgtagtttgttatatgagattgcaaatttatagcctttta

SEQ ID NO: 410 - DNA, 200 bp, Amaranthus palmeri
taaaaggctataaatttgcaatctcatataacaaactacgcatgtccccggccaggccatactgcatcaagtcgctctgatattgccttttttcgaaggacacatttaataaatcacagtaaagcagataacagcattgttaactgaacgacatttggtttcgaacaggaaacaagaatgggaacacagaacgcaaccta

SEQ ID NO: 411 - DNA, 200 bp, Amaranthus palmeri
gagattgcaaatttatagccttttatatggtaaaatcttgtggtaggactaacttaaatcctttttctttcagttagcggaagttacacgagttgacgcagtttggcctggttggggacatgcatcggagatccccgagttgccagattcattagctacgaagggaattgtgtttctgggccccccagctgcatctatgg

SEQ ID NO: 412 - DNA, 200 bp, Amaranthus palmeri
ccatagatgcagctggggggcccagaaacacaattcccttcgtagctaatgaatctggcaactcggggatctccgatgcatgtccccaaccaggccaaactgcgtcaactcgtgtaacttccgctaactgaaagaaaaaggatttaagttagtcctaccacaagattttaccatataaaaggctataaatttgcaatctc

SEQ ID NO: 413 - DNA, 200 bp, Amaranthus palmeri
aaccttgtgcttctaatgtcctttatttctatggactatattagagtacacttcttgttcatgtgatgttgatgttgataattgctacctggtcaatcacaaacaacctctttgttatcacttgaggtgttcaaaatagacccgatgactcgatattcatcagatcttgtaactgaactcgacttcaaaatgaatttaaa

SEQ ID NO: 414 - DNA, 200 bp, Amaranthus palmeri
tttaaattcattttgaagtcgagttcagttacaagatctgatgaatatcgagtcatcgggtctattttgaacacctcaagtgataacaaagaggttgtttgtgattgaccaggtagcaattatcaacatcaacatcacatgaacaagaagtgtactctaatatagtccatagaaataaaggacattagaagcacaaggtt

SEQ ID NO: 415 - DNA, 200 bp, Amaranthus palmeri
aactcgacttcaaaatgaatttaaaattatataaaaatcaatatggacacaagaccggatatcaatccgacccgaaatagttgactcgaaatcaacttgatgatccgaatgaacacctctagttatcacttacaagggtcagattgcgtacatcaaacccctcaaatcctgcttaggtgggagcagtgtcacatgattcg

SEQ ID NO: 416 - DNA, 200 bp, Amaranthus palmeri
cgaatcatgtgacactgctcccacctaagcaggatttgaggggtttgatgtacgcaatctgacccttgtaagtgataactagaggtgttcattcggatcatcaagttgatttcgagtcaactatttcgggtcggattgatatccggtcttgtgtccatattgatttttatataattttaaattcattttgaagtcgagtt

SEQ ID NO: 417 - DNA, 200 bp, Amaranthus palmeri
ggtgggagcagtgtcacatgattcgctagttaattcgcatgtctcgattcgagattcgctcaaaatggaccaaaaatggcccaaaaacgaccaaaattcgcttttttcaattcgcgattcgcagagagattaacgaattatgtgacagtgggtgggagcttgtcaatggcttaggggtaacggaattgtgtgtgctatgt

SEQ ID NO: 418 - DNA, 200 bp, Amaranthus palmeri
acatagcacacacaattccgttacccctaagccattgacaagctcccacccactgtcacataattcgttaatctctctgcgaatcgcgaattgaaaaaagcgaattttggtcgtttttgggccatttttggtccattttgagcgaatctcgaatcgagacatgcgaattaactagcgaatcatgtgacactgctcccacc

SEQ ID NO: 419 - DNA, 200 bp, Amaranthus palmeri
ggtaacggaattgtgtgtgctatgtatattgtgcatctattcttatacgtatgttgagttttttggatcaaatataaagagcttatcttttgtattttcttgatgtggtgtagtggtgatgaagatcaggctcaagagagaatcgataaattggccaaaattctgagagaacaagaagtgagttcagcccttcgtgctgc

SEQ ID NO: 420 - DNA, 200 bp, Amaranthus palmeri
gcagcacgaagggctgaactcacttcttgttctctcagaattttggccaatttatcgattctctcttgagcctgatcttcatcaccactacaccacatcaagaaaatacaaaagataagctctttatatttgatccaaaaaactcaacatacgtataagaatagatgcacaatatacatagcacacacaattccgttacc

SEQ ID NO: 421 - DNA, 200 bp, Amaranthus palmeri
aagtgagttcagcccttcgtgctgctggtgttggtgtgataagttgcatcatacagagagatgaagggcgaactccgatgaggcattcattctattggtcagcagaaaaacaatattatagtgaggagcctttactacgtcatttggaaccccctctatctatgtatctcgagctggtactagtctctgaaccgattgcc

SEQ ID NO: 422 - DNA, 200 bp, Amaranthus palmeri
ggcaatcggttcagagactagtaccagctcgagatacatagatagagggggttccaaatgacgtagtaaaggctcctcactataatattgtttttctgctgaccaatagaatgaatgcctcatcggagttcgcccttcatctctctgtatgatgcaacttatcacaccaacaccagcagcacgaagggctgaactcactt

SEQ ID NO: 423 - DNA, 200 bp, Amaranthus palmeri
ggtactagtctctgaaccgattgcctttcttctgctttgttattttgtgtgatatttcgacttaagtctaatttacatcgttttgtacatttgttatccaaagcacgttaaaagatacttccttcgtttttttacaagcacccaaacacctttttacgcagtccaattggtttgtcgggttgcttatatatagaatttta

SEQ ID NO: 424 - DNA, 200 bp, Amaranthus palmeri
taaaattctatatataagcaacccgacaaaccaattggactgcgtaaaaaggtgtttgggtgcttgtaaaaaaacgaaggaagtatcttttaacgtgctttggataacaaatgtacaaaacgatgtaaattagacttaagtcgaaatatcacacaaaataacaaagcagaagaaaggcaatcggttcagagactagtacc

SEQ ID NO: 425 - DNA, 200 bp, Amaranthus palmeri
cgggttgcttatatatagaattttactcaacttaaaattataaaatttgatattatgaaagtattcgacgagacgaataaaacaaaatcccatatgactgtttttttctcgtttaatagctgtaatatgtaaaatactatcgaatgatgaatagtgtaaaaactggtttgggtgcaactaaaaaaatggaggaagtataa

SEQ ID NO: 426 - DNA, 200 bp, Amaranthus palmeri
ttatacttcctccatttttttagttgcacccaaaccagtttttacactattcatcattcgatagtattttacatattacagctattaaacgagaaaaaaacagtcatatgggattttgttttattcgtctcgtcgaatactttcataatatcaaattttataattttaagttgagtaaaattctatatataagcaacccg

SEQ ID NO: 427 - DNA, 200 bp, Amaranthus palmeri
aactaaaaaaatggaggaagtataattatgcagccaaaactgatggcttctaacttttcatcaactcaggacaagcttaagggttatgaagatatcaaatatactccttcccgtgatcgtcaatggcatctttacacggttattgataaaccattcattcggaggatgtttttgagaacccttgtaagacaacccatctc

SEQ ID NO: 428 - DNA, 200 bp, Amaranthus palmeri
gagatgggttgtcttacaagggttctcaaaaacatcctccgaatgaatggtttatcaataaccgtgtaaagatgccattgacgatcacgggaaggagtatatttgatatcttcataacccttaagcttgtcctgagttgatgaaaagttagaagccatcagttttggctgcataattatacttcctccatttttttagtt

SEQ ID NO: 429 - DNA, 200 bp, Amaranthus palmeri
gaacccttgtaagacaacccatctctgagttcacaggcgtcgaactaagcgctcttgaaacacaaaagcctatctctttcacttcaagaagcatcctaaggtccttaacaaccgccatggaggagttggagctcaatgcacatagtgcttcactgaaacccgatcacgctcatatgtacttgtacattgtccgagagcaa

SEQ ID NO: 430 - DNA, 200 bp, Amaranthus palmeri
ttgctctcggacaatgtacaagtacatatgagcgtgatcgggtttcagtgaagcactatgtgcattgagctccaactcctccatggcggttgttaaggaccttaggatgcttcttgaagtgaaagagataggcttttgtgtttcaagagcgcttagttcgacgcctgtgaactcagagatgggttgtcttacaagggttc

SEQ ID NO: 431 - DNA, 200 bp, Amaranthus palmeri
gtacttgtacattgtccgagagcaacaaatatacgatcttgtgccatatcacaggtatctattgctgcgtgcctcatttttttttgtttattattggtcattagtacaccttattcttagaagaaacttttttcggccaattatttccagggaggtgaacatagatcaccaacaagaagaggcttcggttcaattctttt

SEQ ID NO: 432 - DNA, 200 bp, Amaranthus palmeri
aaaagaattgaaccgaagcctcttcttgttggtgatctatgttcacctccctggaaataattggccgaaaaaagtttcttctaagaataaggtgtactaatgaccaataataaacaaaaaaaaatgaggcacgcagcaatagatacctgtgatatggcacaagatcgtatatttgttgctctcggacaatgtacaagtac

SEQ ID NO: 433 - DNA, 200 bp, Amaranthus palmeri
gaagaggcttcggttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatacctgttcggtacatgtaagtcatag

SEQ ID NO: 434 - DNA, 200 bp, Amaranthus palmeri
ctatgacttacatgtaccgaacaggtatgaccagtcacattagtaactgccaccctccataaaccattagctttcccgggagatgatacccgaagtttcacttcccactcacaaacatttagtttatgcatccttacaccagcaagactatggatttcatgcgcgagatcttccaaaaagaattgaaccgaagcctcttc

SEQ ID NO: 435 - DNA, 200 bp, Amaranthus palmeri
cctgttcggtacatgtaagtcatagttttgagaacctcttttttgatctagtcacaattttgatttttcacaaattcttgtatgagacggtctcaccgtgagaatcaccccatacttggattaaatagccgaataatagaaacttttagcataatggaccttttgtatgaactcgtctcacggagagaaggtctcataca

SEQ ID NO: 436 - DNA, 200 bp, Amaranthus palmeri
tgtatgagaccttctctccgtgagacgagttcatacaaaaggtccattatgctaaaagtttctattattcggctatttaatccaagtatggggtgattctcacggtgagaccgtctcatacaagaatttgtgaaaaatcaaaattgtgactagatcaaaaaagaggttctcaaaactatgacttacatgtaccgaacagg

SEQ ID NO: 437 - DNA, 200 bp, Amaranthus palmeri
tctcacggagagaaggtctcatacaataggggcaattaatttttagctttttatcggtaaattttgcatagtacatagttttgaattttgagaggttgagtctacgtgacaacgaatatttaagtgagtataatgttgtttaatccaaatatgatataaaagggtgtggcatatgtgattgagcattcttttttcttttc

SEQ ID NO: 438 - DNA, 200 bp, Amaranthus palmeri
gaaaagaaaaaagaatgctcaatcacatatgccacacccttttatatcatatttggattaaacaacattatactcacttaaatattcgttgtcacgtagactcaacctctcaaaattcaaaactatgtactatgcaaaatttaccgataaaaagctaaaaattaattgcccctattgtatgagaccttctctccgtgaga

SEQ ID NO: 439 - DNA, 200 bp, Amaranthus palmeri
tgattgagcattcttttttcttttctatgggaagttaaaggtctaaaccttggtataatttccttcaatgatgagcaatcaaagggtttcagacctgtttatttatgactcgaacctgaacccgactctacttgatttttttgacatgcctaaatggaactacagatttattggggaaaataattaaactagaaaatggg

SEQ ID NO: 440 - DNA, 200 bp, Amaranthus palmeri
cccattttctagtttaattattttccccaataaatctgtagttccatttaggcatgtcaaaaaaatcaagtagagtcgggttcaggttcgagtcataaataaacaggtctgaaaccctttgattgctcatcattgaaggaaattataccaaggtttagacctttaacttcccatagaaaagaaaaaagaatgctcaatca

SEQ ID NO: 441 - DNA, 200 bp, Amaranthus palmeri
gaaaataattaaactagaaaatggggaaaacaatttacctagaatgcgttttccgccaaaacaaacactcccaaatacatttcttagcatccacaaatgccgaggaattgcaacggaactaccgatcctcggttcttcaacgtagagacgtatataattcttttttgcacgatatcattaaggttaattgacctgttttt

SEQ ID NO: 442 - DNA, 200 bp, Amaranthus palmeri
aaaaacaggtcaattaaccttaatgatatcgtgcaaaaaagaattatatacgtctctacgttgaagaaccgaggatcggtagttccgttgcaattcctcggcatttgtggatgctaagaaatgtatttgggagtgtttgttttggcggaaaacgcattctaggtaaattgttttccccattttctagtttaattattttc

SEQ ID NO: 443 - DNA, 200 bp, Amaranthus palmeri
cattaaggttaattgacctgttttttctatgaaatataatttaatttttatgctctttagtttgttttactacacatgaatagttttggttttgagtgatcattttcttacattattgatgcccaggtttatcgtgaattggaagatagcaaccttcatgaaatggtctaccattcagtatctgttcacggcccccacca

SEQ ID NO: 444 - DNA, 200 bp, Amaranthus palmeri
tggtgggggccgtgaacagatactgaatggtagaccatttcatgaaggttgctatcttccaattcacgataaacctgggcatcaataatgtaagaaaatgatcactcaaaaccaaaactattcatgtgtagtaaaacaaactaaagagcataaaaattaaattatatttcatagaaaaaacaggtcaattaaccttaatg

SEQ ID NO: 445 - DNA, 200 bp, Amaranthus palmeri
cagtatctgttcacggcccccaccatggggtacctgtgaatgcaccctatcaaccactcggtggcatcgcccgtaagcgacttcaggccatgaaaagtagcacaacttactgttacgattttccactggtacggaatttgaaaatttcatcactccctcccccgtcttccccttaatatactttgtcgcccgttatttca

SEQ ID NO: 446 - DNA, 200 bp, Amaranthus palmeri
tgaaataacgggcgacaaagtatattaaggggaagacgggggagggagtgatgaaattttcaaattccgtaccagtggaaaatcgtaacagtaagttgtgctacttttcatggcctgaagtcgcttacgggcgatgccaccgagtggttgatagggtgcattcacaggtaccccatggtgggggccgtgaacagatactg

SEQ ID NO: 447 - DNA, 200 bp, Amaranthus palmeri
atatactttgtcgcccgttatttcatattccgttttatcaaccatgcaaggatcttccagggttccgaatttcattttttcgtacttccaaagtttcaggcaaacttactttttttgacgctgttgttttcaggctttctcaactgccctgaagcaatcatgggcatcggaagctccggatgtcaagaaaccctcggaca

SEQ ID NO: 448 - DNA, 200 bp, Amaranthus palmeri
tgtccgagggtttcttgacatccggagcttccgatgcccatgattgcttcagggcagttgagaaagcctgaaaacaacagcgtcaaaaaaagtaagtttgcctgaaactttggaagtacgaaaaaatgaaattcggaaccctggaagatccttgcatggttgataaaacggaatatgaaataacgggcgacaaagtatat

SEQ ID NO: 449 - DNA, 200 bp, Amaranthus palmeri
ccggatgtcaagaaaccctcggacaaagcgcttttgaaagtaacggagttagcgtttgctgatccaaaaggcacatggggaactccgcttgttccaataaatcgcaagcctggtatgaacgatgttggcatggtagcctggtacatggaaatgtccacccccgagttccctaatggaagaacaataatggttgtagctaa

SEQ ID NO: 450 - DNA, 200 bp, Amaranthus palmeri
ttagctacaaccattattgttcttccattagggaactcgggggtggacatttccatgtaccaggctaccatgccaacatcgttcataccaggcttgcgatttattggaacaagcggagttccccatgtgccttttggatcagcaaacgctaactccgttactttcaaaagcgctttgtccgagggtttcttgacatccgg

SEQ ID NO: 451 - DNA, 200 bp, Amaranthus palmeri
gaagaacaataatggttgtagctaatgatgttaccttcaaggccggatcttttggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggat

SEQ ID NO: 452 - DNA, 200 bp, Amaranthus palmeri
atccgaccagccaactttaaagcaggattttagctcttcggcaacaccaagtcgagctcctgaattggcagccagataaataagaggaagtttcttcgcgcaagcaagatttgtaacagcaaggaagaaagcatcttctcgtggtccaaaagatccggccttgaaggtaacatcattagctacaaccattattgttcttc

SEQ ID NO: 453 - DNA, 200 bp, Amaranthus palmeri
ctgctttaaagttggctggtcggatgagtcaaatcccgagagtggatttcagtatgtctacttaacccctgaagattacgatcgtataggatcgtcagtcatagcccacgagttaaaactcgaaagtggagaaaaaagatgggttatagataccgttgtaggtaaggaggacggattaggtgttgagaacctatcgggaa

SEQ ID NO: 454 - DNA, 200 bp, Amaranthus palmeri
ttcccgataggttctcaacacctaatccgtcctccttacctacaacggtatctataacccatcttttttctccactttcgagttttaactcgtgggctatgactgacgatcctatacgatcgtaatcttcaggggttaagtagacatactgaaatccactctcgggatttgactcatccgaccagccaactttaaagcag

SEQ ID NO: 455 - DNA, 200 bp, Amaranthus palmeri
ttaggtgttgagaacctatcgggaagtggtgctatagccagtgcatactcaagggcttacaaggaaacatttactctgacttttgtaaccggaagaacggtcggtattggtgcctatcttgctcgtcttgggatgcgttgtatacagaggcttgaccagcctataattctcacgggtttttctgcgttaaataaacttct

SEQ ID NO: 456 - DNA, 200 bp, Amaranthus palmeri
agaagtttatttaacgcagaaaaacccgtgagaattataggctggtcaagcctctgtatacaacgcatcccaagacgagcaagataggcaccaataccgaccgttcttccggttacaaaagtcagagtaaatgtttccttgtaagcccttgagtatgcactggctatagcaccacttcccgataggttctcaacacctaa

SEQ ID NO: 457 - DNA, 200 bp, Amaranthus palmeri
gtttttctgcgttaaataaacttctcggtcgggaggtttatagttcacacatgcaacttggtggaccgaagattatgggcacaaacggggtagttcatcttacagtatccgatgatcttgaaggcatttcatctatcttgaagtggctgagctacgttccaccctattcaggtggtgaacttccgatttctcggtgttta

SEQ ID NO: 458 - DNA, 200 bp, Amaranthus palmeri
taaacaccgagaaatcggaagttcaccacctgaatagggtggaacgtagctcagccacttcaagatagatgaaatgccttcaagatcatcggatactgtaagatgaactaccccgtttgtgcccataatcttcggtccaccaagttgcatgtgtgaactataaacctcccgaccgagaagtttatttaacgcagaaaaac

SEQ ID NO: 459 - DNA, 200 bp, Amaranthus palmeri
tgaacttccgatttctcggtgtttagaccctccaggaagaccggttgcgtatttgcctgaaaattcttgtgatcctcgtggtgctatatctggtacggttgactccaccggtaaatggtttgggggtattttcgacaaggatagttttgtggaaaccttagaaggatgggcacaaacagttgtcacgggaagggctaaac

SEQ ID NO: 460 - DNA, 200 bp, Amaranthus palmeri
gtttagcccttcccgtgacaactgtttgtgcccatccttctaaggtttccacaaaactatccttgtcgaaaatacccccaaaccatttaccggtggagtcaaccgtaccagatatagcaccacgaggatcacaagaattttcaggcaaatacgcaaccggtcttcctggagggtctaaacaccgagaaatcggaagttca

SEQ ID NO: 461 - DNA, 200 bp, Amaranthus palmeri
acagttgtcacgggaagggctaaactcggaggaattccagttggcatagttgccgttgagacgcagactgttatgcaagtaatcccagcagatcccggtcaactcgactcacacgagagagtcgtaccacaagcagggcaagtatggttcccagattctgcatccaagacagcacaagcgctgatggatttcaaccggga

SEQ ID NO: 462 - DNA, 200 bp, Amaranthus palmeri
tcccggttgaaatccatcagcgcttgtgctgtcttggatgcagaatctgggaaccatacttgccctgcttgtggtacgactctctcgtgtgagtcgagttgaccgggatctgctgggattacttgcataacagtctgcgtctcaacggcaactatgccaactggaattcctccgagtttagcccttcccgtgacaactgt

SEQ ID NO: 463 - DNA, 200 bp, Amaranthus palmeri
aagcgctgatggatttcaaccgggaagaactcccacttttcattttagctaattggagaggtttctcgggtggacaaagggatctctttgaagggatccttcaggccggatccaccatagttgaaaatcttaggacttataatcaacccgtttttgtttatatccctatgatgggggagcttcgaggaggcgcatgggtg

SEQ ID NO: 464 - DNA, 200 bp, Amaranthus palmeri
cacccatgcgcctcctcgaagctcccccatcatagggatataaacaaaaacgggttgattataagtcctaagattttcaactatggtggatccggcctgaaggatcccttcaaagagatccctttgtccacccgagaaacctctccaattagctaaaatgaaaagtgggagttcttcccggttgaaatccatcagcgctt

SEQ ID NO: 465 - DNA, 200 bp, Amaranthus palmeri
ggagcttcgaggaggcgcatgggtggtcgtcgatagtcgaattaattccgaccatatagaaatgtacgccgaccaaacagctaaaggaaatgtgcttgaaccggaaggaatgattgagattaagttccgaaccaaggaacttctcgagtgtatgggaaggcttgatcaacaactcatcggtctcaaggaaaaactagccg

SEQ ID NO: 466 - DNA, 200 bp, Amaranthus palmeri
cggctagtttttccttgagaccgatgagttgttgatcaagccttcccatacactcgagaagttccttggttcggaacttaatctcaatcattccttccggttcaagcacatttcctttagctgtttggtcggcgtacatttctatatggtcggaattaattcgactatcgacgaccacccatgcgcctcctcgaagctcc

SEQ ID NO: 467 - DNA, 200 bp, Amaranthus palmeri
atcggtctcaaggaaaaactagccgaagccaagagctctaattcctacaataaaatcgagcccctgcagcaacaaataaaagcccgtgagaagcaactattgcctctatatactcaaatagccaccaaatttgccgagttgcacgatacgtctttaaggatggctgccaaaggagtcattagggacgtcttggaatggaa

SEQ ID NO: 468 - DNA, 200 bp, Amaranthus palmeri
ttccattccaagacgtccctaatgactcctttggcagccatccttaaagacgtatcgtgcaactcggcaaatttggtggctatttgagtatatagaggcaatagttgcttctcacgggcttttatttgttgctgcaggggctcgattttattgtaggaattagagctcttggcttcggctagtttttccttgagaccgat

SEQ ID NO: 469 - DNA, 200 bp, Amaranthus palmeri
tcattagggacgtcttggaatggaaaagctcgcgttcgttcttttacaaaagattatacaggagagttatggaggaatcgctcgtcaagactgttcgagatgctgcaggtgaacggttgacccataagtcggctttggagttgatccaaaaatggttcaatgagtcgaatatttccggagaggcttccgatgcttgggct

SEQ ID NO: 470 - DNA, 200 bp, Amaranthus palmeri
agcccaagcatcggaagcctctccggaaatattcgactcattgaaccatttttggatcaactccaaagccgacttatgggtcaaccgttcacctgcagcatctcgaacagtcttgacgagcgattcctccataactctcctgtataatcttttgtaaaagaacgaacgcgagcttttccattccaagacgtccctaatga

SEQ ID NO: 471 - DNA, 200 bp, Amaranthus palmeri
cggagaggcttccgatgcttgggctgatgatgcggccttctttaagtggaaggacaataccgccaactacgaggagaagttgaaagagttgcgcgttcagaaggtattggatcagctgtcgaatattggagattcggcaactaatttgagggctctgcctcagggtcttgctgccctacttcaaaaggtaatctgattta

SEQ ID NO: 472 - DNA, 200 bp, Amaranthus palmeri
taaatcagattaccttttgaagtagggcagcaagaccctgaggcagagccctcaaattagttgccgaatctccaatattcgacagctgatccaataccttctgaacgcgcaactctttcaacttctcctcgtagttggcggtattgtccttccacttaaagaaggccgcatcatcagcccaagcatcggaagcctctccg

SEQ ID NO: 473 - DNA, 200 bp, Amaranthus palmeri
agatgtgtataagagacagtataatcaagttttttagtacccaaagctctaaatgttacttaaagttttgatcttttaatggtttcttctatttaatccaataatttaaagtacccagatttcaatttttagaataaattgagtttttgaattgcccaagttgtaattgttgctgaattctcttgctttgatttgggttt

SEQ ID NO: 474 - DNA, 200 bp, Amaranthus palmeri
aaacccaaatcaaagcaagagaattcagcaacaattacaacttgggcaattcaaaaactcaatttattctaaaaattgaaatctgggtactttaaattattggattaaatagaagaaaccattaaaagatcaaaactttaagtaacatttagagctttgggtactaaaaaacttgattatactgtctcttatacacatct

SEQ ID NO: 475 - DNA, 200 bp, Amaranthus palmeri
aattctcttgctttgatttgggttttctgattctatcccttctgattcatacagtttcaggagcagtggtctcattttcgagcaatacaaaaagtgccgtgcttctctaaacaacgacgattcagacatgtcttctccttcccacaataatgaaaacccgaacggaccgatgatgccactcctgaggaattcatctgtag

SEQ ID NO: 476 - DNA, 200 bp, Amaranthus palmeri
ctacagatgaattcctcaggagtggcatcatcggtccgttcgggttttcattattgtgggaaggagaagacatgtctgaatcgtcgttgtttagagaagcacggcactttttgtattgctcgaaaatgagaccactgctcctgaaactgtatgaatcagaagggatagaatcagaaaacccaaatcaaagcaagagaatt

SEQ ID NO: 477 - DNA, 200 bp, Amaranthus palmeri
ccactcctgaggaattcatctgtagtatccattgttgataagttctgttatgctcttggagggacgcggccaatccatagtattttgatagcaaacaatgggatggctgctgtcaaatttataagaagtatccgaacatgggcttacgagacttttggtactgagaaggctatattattggtagccatggctactcccga

SEQ ID NO: 478 - DNA, 200 bp, Amaranthus palmeri
tcgggagtagccatggctaccaataatatagccttctcagtaccaaaagtctcgtaagcccatgttcggatacttcttataaatttgacagcagccatcccattgtttgctatcaaaatactatggattggccgcgtccctccaagagcataacagaacttatcaacaatggatactacagatgaattcctcaggagtgg

SEQ ID NO: 479 - DNA, 200 bp, Amaranthus palmeri
tattggtagccatggctactcccgaagacatgaaaatcaatgccgagcatattcgaatggctgatcagtttgttgaagtccccggaggaactaacaacaataactacgccaatgtgcagctcattgttgagttagcggaagttacacgagttgacgcagtttggcctggttggggacatgcatcggagatccccgagttg

SEQ ID NO: 480 - DNA, 200 bp, Amaranthus palmeri
caactcggggatctccgatgcatgtccccaaccaggccaaactgcgtcaactcgtgtaacttccgctaactcaacaatgagctgcacattggcgtagttattgttgttagttcctccggggacttcaacaaactgatcagccattcgaatatgctcggcattgattttcatgtcttcgggagtagccatggctaccaata

SEQ ID NO: 481 - DNA, 200 bp, Amaranthus palmeri
atagctccaccagaaacggtgaagaagcttgagcaagcagctagaagattggctttatgtgtgggttatgttggcgcagctacagttgaatatttatacagcatggaaacaggcgagttccatttccttgagttgaatcctcggttacaggtatggagcttccccaacttcttttaagtacccattatgtaactgcatat

SEQ ID NO: 482 - DNA, 200 bp, Amaranthus palmeri
atatgcagttacataatgggtacttaaaagaagttggggaagctccatacctgtaaccgaggattcaactcaaggaaatggaactcgcctgtttccatgctgtataaatattcaactgtagctgcgccaacataacccacacataaagccaatcttctagctgcttgctcaagcttcttcaccgtttctggtggagctat

SEQ ID NO: 483 - DNA, 200 bp, Amaranthus palmeri
aagtacccattatgtaactgcatatttatgtaatccctccattccaaattagtcgctatgtattcctatggggatgtcccaaattagttgcaacgtttctgtaatatggtaaagttttcccctccaaaccttaaaacctagttgaccataatctaactaaacccaattctcgacccactttgaaaaacaggtcaaatgtt

SEQ ID NO: 484 - DNA, 200 bp, Amaranthus palmeri
aacatttgacctgtttttcaaagtgggtcgagaattgggtttagttagattatggtcaactaggttttaaggtttggaggggaaaactttaccatattacagaaacgttgcaactaatttgggacatccccataggaatacatagcgactaatttggaatggagggattacataaatatgcagttacataatgggtactt

SEQ ID NO: 485 - DNA, 200 bp, Amaranthus palmeri
cactttgaaaaacaggtcaaatgttggtgtttgaaccacctttgaagaaatttaagattttgggttggtaatgcttattagagatttgggtttgtggcatcggcattattttggtgtcgatttgcaaatgatatcccgggatttcgaactaggaggggattcaattggtttttgaggaatttatgtaattattcctttaa

SEQ ID NO: 486 - DNA, 200 bp, Amaranthus palmeri
ttaaaggaataattacataaattcctcaaaaaccaattgaatcccctcctagttcgaaatcccgggatatcatttgcaaatcgacaccaaaataatgccgatgccacaaacccaaatctctaataagcattaccaacccaaaatcttaaatttcttcaaaggtggttcaaacaccaacatttgacctgtttttcaaagtg

SEQ ID NO: 487 - DNA, 200 bp, Amaranthus palmeri
ggaatttatgtaattattcctttaattagtgatcattgaattgattgtatttgtgttggggaattggacccgtgaagaaaaaaatgacgggttagcttttggattagtgagtgattatgtgagtttaatttgtctatgaatggtcaatttcaagcaacattttctgttttagcttagtaatttttgggatgcgattgaac

SEQ ID NO: 488 - DNA, 200 bp, Amaranthus palmeri
gttcaatcgcatcccaaaaattactaagctaaaacagaaaatgttgcttgaaattgaccattcatagacaaattaaactcacataatcactcactaatccaaaagctaacccgtcatttttttcttcacgggtccaattccccaacacaaatacaatcaattcaatgatcactaattaaaggaataattacataaattcc

SEQ ID NO: 489 - DNA, 200 bp, Amaranthus palmeri
agtaatttttgggatgcgattgaacatttgagcaccttctggattattaacagaaatgatcatcgaaattgatttttttagttgttgacagtagaatagtaacagataaggtagaataatacagtataatctttagttgcgacaatttccaacgtttttataatagctaaagctacattctcatgttgcttgatgaaagt

SEQ ID NO: 490 - DNA, 200 bp, Amaranthus palmeri
actttcatcaagcaacatgagaatgtagctttagctattataaaaacgttggaaattgtcgcaactaaagattatactgtattattctaccttatctgttactattctactgtcaacaactaaaaaaatcaatttcgatgatcatttctgttaataatccagaaggtgctcaaatgttcaatcgcatcccaaaaattact

SEQ ID NO: 491 - DNA, 200 bp, Amaranthus palmeri
cattctcatgttgcttgatgaaagtgactgtatttattccgtgtgcttatacaggtggagcatcctgttactgagtggattgccgaggtaaatcttccagctgctcaagttgcagttggcatgggtatcccactttggcaaattcctggtaaatgtccagtactcttttttcggttatgtaacttatatattatatctaa

SEQ ID NO: 492 - DNA, 200 bp, Amaranthus palmeri
ttagatataatatataagttacataaccgaaaaaagagtactggacatttaccaggaatttgccaaagtgggatacccatgccaactgcaacttgagcagctggaagatttacctcggcaatccactcagtaacaggatgctccacctgtataagcacacggaataaatacagtcactttcatcaagcaacatgagaatg

SEQ ID NO: 493 - DNA, 200 bp, Amaranthus palmeri
tatgtaacttatatattatatctaattcttatttacgaaccgaattgatcacacatttttaaaacagaaatccgtcggttctatgggaaggaacatggtgggggttatgatacttggatgaggacatctgctttggctactgcttttgattttaacgaggcacagtcggtgaaacctaaaggtcattgtattgctgcgcg

SEQ ID NO: 494 - DNA, 200 bp, Amaranthus palmeri
cgcgcagcaatacaatgacctttaggtttcaccgactgtgcctcgttaaaatcaaaagcagtagccaaagcagatgtcctcatccaagtatcataacccccaccatgttccttcccatagaaccgacggatttctgttttaaaaatgtgtgatcaattcggttcgtaaataagaattagatataatatataagttacata

SEQ ID NO: 495 - DNA, 200 bp, Amaranthus palmeri
ctaaaggtcattgtattgctgcgcgtgtgacaagtgaggatcccgatgacggttttaagcctacaagcgggaaagtacaggttagaccatcctggttttgtcgatttacttccacaattggtcttgtttttattttgcctttgcggcgaagaattttctttaatgggtgctttgtttaggagctgagttttaaaagtaaa

SEQ ID NO: 496 - DNA, 200 bp, Amaranthus palmeri
tttacttttaaaactcagctcctaaacaaagcacccattaaagaaaattcttcgccgcaaaggcaaaataaaaacaagaccaattgtggaagtaaatcgacaaaaccaggatggtctaacctgtactttcccgcttgtaggcttaaaaccgtcatcgggatcctcacttgtcacacgcgcagcaatacaatgacctttag

SEQ ID NO: 497 - DNA, 200 bp, Amaranthus palmeri
ttaggagctgagttttaaaagtaaaccgaatgtgtgggcctacttctctgttaaggtattttccatatttctttaattctttgattttcgcgttaacaatttcagttcactccattatgggtttgatgatgataaacacttttatttgcagtctgggggaggcattcatgagttctcggattctcaatttggtaagttaa

SEQ ID NO: 498 - DNA, 200 bp, Amaranthus palmeri
ttaacttaccaaattgagaatccgagaactcatgaatgcctcccccagactgcaaataaaagtgtttatcatcatcaaacccataatggagtgaactgaaattgttaacgcgaaaatcaaagaattaaagaaatatggaaaataccttaacagagaagtaggcccacacattcggtttacttttaaaactcagctcctaa

SEQ ID NO: 499 - DNA, 200 bp, Amaranthus palmeri
tcggattctcaatttggtaagttaatggtgcaaactcttgtcagtaatgttaactccagtttcacatgatttgctagtctttttgtgatttgcgaatcaaaaaagagaattattgtcggttttgggctattttttattccatttggagccaatggacattcaaaaagcaaatagctagcgaattttgttgatattctgga

SEQ ID NO: 500 - DNA, 200 bp, Amaranthus palmeri
tccagaatatcaacaaaattcgctagctatttgctttttgaatgtccattggctccaaatggaataaaaaatagcccaaaaccgacaataattctcttttttgattcgcaaatcacaaaaagactagcaaatcatgtgaaactggagttaacattactgacaagagtttgcaccattaacttaccaaattgagaatccga

SEQ ID NO: 501 - DNA, 200 bp, Amaranthus palmeri
tagcgaattttgttgatattctggaggtgtatattgatgagaattttacaataaattgctgctgctgcactgtgctatattttggaaacactgaatgactttcaattgtttgtaaagtttgcatattcgagtcacaacatgatgtcataatgaaatgcgagcggtttttattaaataatagagccgtagtgtaaaaacaa

SEQ ID NO: 502 - DNA, 200 bp, Amaranthus palmeri
ttgtttttacactacggctctattatttaataaaaaccgctcgcatttcattatgacatcatgttgtgactcgaatatgcaaactttacaaacaattgaaagtcattcagtgtttccaaaatatagcacagtgcagcagcagcaatttattgtaaaattctcatcaatatacacctccagaatatcaacaaaattcgcta

SEQ ID NO: 503 - DNA, 200 bp, Amaranthus palmeri
taatagagccgtagtgtaaaaacaaggccgcattgcatcgtgttggctgcattgtaaaggttttcaaaaacaatgaactgatatttcccacgttgtaaaggcataaaacattgcgtttagggaaatatcaaagaatatcttaaggtttcaaccgatatttaggtggtgcaatgaccgcattactcccgttaccgcattac

SEQ ID NO: 504 - DNA, 200 bp, Amaranthus palmeri
gtaatgcggtaacgggagtaatgcggtcattgcaccacctaaatatcggttgaaaccttaagatattctttgatatttccctaaacgcaatgttttatgcctttacaacgtgggaaatatcagttcattgtttttgaaaacctttacaatgcagccaacacgatgcaatgcggccttgtttttacactacggctctatta

SEQ ID NO: 505 - DNA, 200 bp, Amaranthus palmeri
cgcattactcccgttaccgcattaccgttccttgctgcgatcacgatcgttaccgcatttttacactatgaatagaccttcagttcatattttatgatggctaaaatcaattacttggttaaaggtatatacgaaggctaacaaaagcatttctttacaggccatgtttttgcatttggtgaaaaccgaggtttggccat

SEQ ID NO: 506 - DNA, 200 bp, Amaranthus palmeri
atggccaaacctcggttttcaccaaatgcaaaaacatggcctgtaaagaaatgcttttgttagccttcgtatatacctttaaccaagtaattgattttagccatcataaaatatgaactgaaggtctattcatagtgtaaaaatgcggtaacgatcgtgatcgcagcaaggaacggtaatgcggtaacgggagtaatgcg

SEQ ID NO: 507 - DNA, 200 bp, Amaranthus palmeri
ttggtgaaaaccgaggtttggccatagcaaatatgattcttggattaaaagaaattcaaattcgtggagaaattcgaactaatgttgattacaccatcgatcttttaaatgtgagtttgaatgtaattcttgttgtctttttttagttttcgcctttcttctgttaaacctttgaagttctcacacttaacttttttttc

SEQ ID NO: 508 - DNA, 200 bp, Amaranthus palmeri
gaaaaaaaagttaagtgtgagaacttcaaaggtttaacagaagaaaggcgaaaactaaaaaaagacaacaagaattacattcaaactcacatttaaaagatcgatggtgtaatcaacattagttcgaatttctccacgaatttgaatttcttttaatccaagaatcatatttgctatggccaaacctcggttttcaccaa

SEQ ID NO: 509 - DNA, 200 bp, Amaranthus palmeri
agttctcacacttaacttttttttcctccagtgtttggattatagagaaaaccaaattcatacaggttggttggatagtagaattgcgatgagggtcagagctgaaaggccaccttggtacatctctgttgtgggaggagggctttacgtatgtacaactttttcacagctatcattaatttttccgttgttatgatctg

SEQ ID NO: 510 - DNA, 200 bp, Amaranthus palmeri
cagatcataacaacggaaaaattaatgatagctgtgaaaaagttgtacatacgtaaagccctcctcccacaacagagatgtaccaaggtggcctttcagctctgaccctcatcgcaattctactatccaaccaacctgtatgaatttggttttctctataatccaaacactggaggaaaaaaaagttaagtgtgagaact

SEQ ID NO: 511 - DNA, 200 bp, Amaranthus palmeri
ttaatttttccgttgttatgatctgtgttacttggactcgggttgttggatactggtatgtgtccacgtgtcggatacgtctaaatattcaattttacgcctaaaatgaagtatctaagtgccatgtccgagcatcaaggatcggacacgggtacgtgaagccaaatgaagagtccgagtaacataagttatgattaatg

SEQ ID NO: 512 - DNA, 200 bp, Amaranthus palmeri
cattaatcataacttatgttactcggactcttcatttggcttcacgtacccgtgtccgatccttgatgctcggacatggcacttagatacttcattttaggcgtaaaattgaatatttagacgtatccgacacgtggacacataccagtatccaacaacccgagtccaagtaacacagatcataacaacggaaaaattaa

SEQ ID NO: 513 - DNA, 200 bp, Amaranthus palmeri
cgagtaacataagttatgattaatgttaaataacttgttttctttatcctctatatccagaaagcatcgactagtagtgcagcgactgtttcagagtatataggctatcttgaaaaaggtcaaattcctccgaaggtatgtaacatacaattggttggcgggtgtttagattaacttattctattaatatcaattatact

SEQ ID NO: 514 - DNA, 200 bp, Amaranthus palmeri
agtataattgatattaatagaataagttaatctaaacacccgccaaccaattgtatgttacataccttcggaggaatttgacctttttcaagatagcctatatactctgaaacagtcgctgcactactagtcgatgctttctggatatagaggataaagaaaacaagttatttaacattaatcataacttatgttactcg

SEQ ID NO: 515 - DNA, 200 bp, Amaranthus palmeri
ttattctattaatatcaattatactttcagtgttctgctttaattctggtttcatgattgcagcatatatcactcgtccactatgaagttgctctaaatatcgaggggatgaaatataccgtatgttccatgccattcgtactttcctcgtgaatttttgttatggatgctatttttgacattttctttctaaatatatt

SEQ ID NO: 516 - DNA, 200 bp, Amaranthus palmeri
aatatatttagaaagaaaatgtcaaaaatagcatccataacaaaaattcacgaggaaagtacgaatggcatggaacatacggtatatttcatcccctcgatatttagagcaacttcatagtggacgagtgatatatgctgcaatcatgaaaccagaattaaagcagaacactgaaagtataattgatattaatagaataa

SEQ ID NO: 517 - DNA, 200 bp, Amaranthus palmeri
ttgacattttctttctaaatatattttcttgaaattaatgaacatgtcgtttcggattgccagattgagatgattaggggtggaccaggaagctacaaaatgtggttgaatgggtccgtagttgaggcggaaatacatactttaagagatgggggtctcttgatgcaggtatcaaatgttttttgatatttttttttctg

SEQ ID NO: 518 - DNA, 200 bp, Amaranthus palmeri
cagaaaaaaaaatatcaaaaaacatttgatacctgcatcaagagacccccatctcttaaagtatgtatttccgcctcaactacggacccattcaaccacattttgtagcttcctggtccacccctaatcatctcaatctggcaatccgaaacgacatgttcattaatttcaagaaaatatatttagaaagaaaatgtcaa

SEQ ID NO: 519 - DNA, 200 bp, Amaranthus palmeri
atgttttttgatatttttttttctgatatacggtatttatattttatatccaaagcatggtgataataccctggatttgtaaagcattagataatgtgttatcaaacaagtagaatgtagttttgtgaaatcgtgaagcgtttagtttagatttaaattttaatactcctacaatgcttgggatattaatcaataatcat

SEQ ID NO: 520 - DNA, 200 bp, Amaranthus palmeri
atgattattgattaatatcccaagcattgtaggagtattaaaatttaaatctaaactaaacgcttcacgatttcacaaaactacattctacttgtttgataacacattatctaatgctttacaaatccagggtattatcaccatgctttggatataaaatataaataccgtatatcagaaaaaaaaatatcaaaaaacat

SEQ ID NO: 521 - DNA, 200 bp, Amaranthus palmeri
gcttgggatattaatcaataatcatgcttcaaatagtaaagagaaatattgtcatagactcataggtataatggctcgttaaatcatatgcacttcttgtttatgtgaagtccgagttggtgtttgcaatcaacgtttgaaatcaagggcatagtgctaaatctcgaatgtggtcacttttgtggtcaatgtagatggtt

SEQ ID NO: 522 - DNA, 200 bp, Amaranthus palmeri
aaccatctacattgaccacaaaagtgaccacattcgagatttagcactatgcccttgatttcaaacgttgattgcaaacaccaactcggacttcacataaacaagaagtgcatatgatttaacgagccattatacctatgagtctatgacaatatttctctttactatttgaagcatgattattgattaatatcccaagc

SEQ ID NO: 523 - DNA, 200 bp, Amaranthus palmeri
acttttgtggtcaatgtagatggtttcatttctatcgtggtataaatatgggtcgcagtaatcttaagaacctatatagtagacgataacttgttattaaaagggtaaaggctgcatacatccgatgtcccatttacccggtctagatgtgagctacttggggttattgttattgaagttaaagatacaagagggattac

SEQ ID NO: 524 - DNA, 200 bp, Amaranthus palmeri
gtaatccctcttgtatctttaacttcaataacaataaccccaagtagctcacatctagaccgggtaaatgggacatcggatgtatgcagcctttacccttttaataacaagttatcgtctactatataggttcttaagattactgcgacccatatttataccacgatagaaatgaaaccatctacattgaccacaaaagt

SEQ ID NO: 525 - DNA, 200 bp, Amaranthus palmeri
aagttaaagatacaagagggattactgtttgaaaaaacggaatatttgaactacaaaaaaagtaattagtttaggtactagttcgttctagcccatataacacattttaaaaaaatatatgaaaaagggctttcaatgtcatgaacggaagggagcaaatggacagtggaagagtcaacaaagattacatatgatttatg

SEQ ID NO: 526 - DNA, 200 bp, Amaranthus palmeri
cataaatcatatgtaatctttgttgactcttccactgtccatttgctcccttccgttcatgacattgaaagccctttttcatatatttttttaaaatgtgttatatgggctagaacgaactagtacctaaactaattactttttttgtagttcaaatattccgttttttcaaacagtaatccctcttgtatctttaactt

SEQ ID NO: 527 - DNA, 200 bp, Amaranthus palmeri
caacaaagattacatatgatttatgaattctctttcgttgtttaaaaaactttgaaattgaaaattgttggctttttgttgaagaaacgatgtgtgtcagttgaaatcagaatatttaaactacaaaaaaagctattagtttatacacaatacacttgttcgtttaaacccatatagtacatttaaataattatttgaaa

SEQ ID NO: 528 - DNA, 200 bp, Amaranthus palmeri
tttcaaataattatttaaatgtactatatgggtttaaacgaacaagtgtattgtgtataaactaatagctttttttgtagtttaaatattctgatttcaactgacacacatcgtttcttcaacaaaaagccaacaattttcaatttcaaagttttttaaacaacgaaagagaattcataaatcatatgtaatctttgttg

SEQ ID NO: 529 - DNA, 200 bp, Amaranthus palmeri
agtacatttaaataattatttgaaaagggctgttaatgtgtgaaaactttcgatatgttgatctgattggatatgtgtcataccttgaaacgtcatgcagttggacggaaacagccatgtgatatatgccgaggaagaagctgcaggaactcgccttctgattgatggaagaacttgtttgcttcaggtaatgccgtgtg

SEQ ID NO: 530 - DNA, 200 bp, Amaranthus palmeri
cacacggcattacctgaagcaaacaagttcttccatcaatcagaaggcgagttcctgcagcttcttcctcggcatatatcacatggctgtttccgtccaactgcatgacgtttcaaggtatgacacatatccaatcagatcaacatatcgaaagttttcacacattaacagcccttttcaaataattatttaaatgtact

SEQ ID NO: 531 - DNA, 200 bp, Amaranthus palmeri
tgtttgcttcaggtaatgccgtgtgattctcttttttttttttttttgtgaattctaaaccttaaaaatcattctccaccaaacttgttcattttttcatatagaacgatcacgatccttcaaagctgattgcggagacaccgtgtaagcttatgcggtatttggtaccagataacagtcacatagatgcagatactccg

SEQ ID NO: 532 - DNA, 200 bp, Amaranthus palmeri
cggagtatctgcatctatgtgactgttatctggtaccaaataccgcataagcttacacggtgtctccgcaatcagctttgaaggatcgtgatcgttctatatgaaaaaatgaacaagtttggtggagaatgatttttaaggtttagaattcacaaaaaaaaaaaaaaaagagaatcacacggcattacctgaagcaaaca

SEQ ID NO: 533 - DNA, 200 bp, Amaranthus palmeri
cagtcacatagatgcagatactccgtatgctgaagttgaggtcatgaagatgtgtatgcctttgctttccccagcatccggtgttttacaatttaagatgtccgaaggtcaagctatgcaggtatgcatcattttaatcgtaaattcagcaacctcgtttatattggattctaaatatggtcttgctgtgtaggctggtg

SEQ ID NO: 534 - DNA, 200 bp, Amaranthus palmeri
caccagcctacacagcaagaccatatttagaatccaatataaacgaggttgctgaatttacgattaaaatgatgcatacctgcatagcttgaccttcggacatcttaaattgtaaaacaccggatgctggggaaagcaaaggcatacacatcttcatgacctcaacttcagcatacggagtatctgcatctatgtgactg

SEQ ID NO: 535 - DNA, 200 bp, Amaranthus palmeri
tatggtcttgctgtgtaggctggtgaactcatagctagtctagagttggatgatccttcagctgtaagaaaagccgaacctttcagtggaagctttcctgtcatgggctcaccaactgcaatatctggaaaagttcatcagaggtgtgccgcaagtttaaatgccgctcggatgattttggctggttatgaacacaatat

SEQ ID NO: 536 - DNA, 200 bp, Amaranthus palmeri
atattgtgttcataaccagccaaaatcatccgagcggcatttaaacttgcggcacacctctgatgaacttttccagatattgcagttggtgagcccatgacaggaaagcttccactgaaaggttcggcttttcttacagctgaaggatcatccaactctagactagctatgagttcaccagcctacacagcaagaccata

SEQ ID NO: 537 - DNA, 200 bp, Amaranthus palmeri
ttttggctggttatgaacacaatatagatgaagtaagtttcaaaccaccatttcatttttcatcaacatagtttttaggctagcctcttaatgggttgatgccatagtgtaaaaacaaggccacatcgcatcacgtcaccgcgttgtaaaggatttcaaaaacaacgaaccgatatttcccacattgtgggctgtatcaa

SEQ ID NO: 538 - DNA, 200 bp, Amaranthus palmeri
ttgatacagcccacaatgtgggaaatatcggttcgttgtttttgaaatcctttacaacgcggtgacgtgatgcgatgtggccttgtttttacactatggcatcaacccattaagaggctagcctaaaaactatgttgatgaaaaatgaaatggtggtttgaaacttacttcatctatattgtgttcataaccagccaaaa

SEQ ID NO: 539 - DNA, 200 bp, Amaranthus palmeri
tttcccacattgtgggctgtatcaagggatattttatggttttgaccggtatttaggcgttacaataaccgcatcactcccgttaccgcatcattgttctgttaccgtgatcatgaccgttaccgcatttttacactatggatgccgaaccttgagatgcatttcccatttttcaatagagcccctagtttttttcttcc

SEQ ID NO: 540 - DNA, 200 bp, Amaranthus palmeri
ggaagaaaaaaactaggggctctattgaaaaatgggaaatgcatctcaaggttcggcatccatagtgtaaaaatgcggtaacggtcatgatcacggtaacagaacaatgatgcggtaacgggagtgatgcggttattgtaacgcctaaataccggtcaaaaccataaaatatcccttgatacagcccacaatgtgggaaa

SEQ ID NO: 541 - DNA, 200 bp, Amaranthus palmeri
atagagcccctagtttttttcttcctgtttggaaattttttacatgtgagccttttattttctcaggtagtacagagtttgctggaatgccttgatagtcccgaacttccattccttcaatggcaagaatgcttgtctgtgctggcaacacgactccccaaagatctgagatacgaagtgtgtattctatcatctgttct

SEQ ID NO: 542 - DNA, 200 bp, Amaranthus palmeri
agaacagatgatagaatacacacttcgtatctcagatctttggggagtcgtgttgccagcacagacaagcattcttgccattgaaggaatggaagttcgggactatcaaggcattccagcaaactctgtactacctgagaaaataaaaggctcacatgtaaaaaatttccaaacaggaagaaaaaaactaggggctctat

SEQ ID NO: 543 - DNA, 200 bp, Amaranthus palmeri
aagtgtgtattctatcatctgttcttgatttagttatttatatttccttataataattttgaactttttcctcggaatttacagttggaatcaaaatctagagcttttgaagcgattaccaacaccccaaacatagaatttcctgctaagttgttgaaaagtattcttgaggttagtacctcactttgttaccttctgta

SEQ ID NO: 544 - DNA, 200 bp, Amaranthus palmeri
tacagaaggtaacaaagtgaggtactaacctcaagaatacttttcaacaacttagcaggaaattctatgtttggggtgttggtaatcgcttcaaaagctctagattttgattccaactgtaaattccgaggaaaaagttcaaaattattataaggaaatataaataactaaatcaagaacagatgatagaatacacactt

SEQ ID NO: 545 - DNA, 200 bp, Amaranthus palmeri
gtacctcactttgttaccttctgtaaattattcactcggcgagttactcatgttagtaacaagtttattcttcataggaccatttaaactcatgccaagagaaagataaaggagctcaagagaggcttattgagcctcttatggttcttgtaaagtcttacgaaggtgggcgagaaagtcatgctcgttttattgttcaa

SEQ ID NO: 546 - DNA, 200 bp, Amaranthus palmeri
ttgaacaataaaacgagcatgactttctcgcccaccttcgtaagactttacaagaaccataagaggctcaataagcctctcttgagctcctttatctttctcttggcatgagtttaaatggtcctatgaagaataaacttgttactaacatgagtaactcgccgagtgaataatttacagaaggtaacaaagtgaggtac

SEQ ID NO: 547 - DNA, 200 bp, Amaranthus palmeri
aagtcatgctcgttttattgttcaatctttatttgaagagtatttatccgttgaagaattgtttagcgacaatctccaggtttgtccatctatctagagcaatttgattatgatgtttttttaaagttcataaattttagcttggtgccacaccgtcagtggctgatgatcgtcgctttgtgatcattaagcttttaaaa

SEQ ID NO: 548 - DNA, 200 bp, Amaranthus palmeri
ttttaaaagcttaatgatcacaaagcgacgatcatcagccactgacggtgtggcaccaagctaaaatttatgaactttaaaaaaacatcataatcaaattgctctagatagatggacaaacctggagattgtcgctaaacaattcttcaacggataaatactcttcaaataaagattgaacaataaaacgagcatgactt

SEQ ID NO: 549 - DNA, 200 bp, Amaranthus palmeri
ctttgtgatcattaagcttttaaaagctgtctcctgttctccatcactatttttagaaattttgagttctgatgtatatactcggtacctgagggactctttggccgctttcttctttatgggtatgaattgcctccttccttccctccccagatcctgatcatagtttctatgagcgggatacattgggtatgatgatg

SEQ ID NO: 550 - DNA, 200 bp, Amaranthus palmeri
catcatcatacccaatgtatcccgctcatagaaactatgatcaggatctggggagggaaggaaggaggcaattcatacccataaagaagaaagcggccaaagagtccctcaggtaccgagtatatacatcagaactcaaaatttctaaaaatagtgatggagaacaggagacagcttttaaaagcttaatgatcacaaag

SEQ ID NO: 551 - DNA, 200 bp, Amaranthus palmeri
gcgggatacattgggtatgatgatgattattattattattatcgctatttgaacaatttttcttatgttatttaactcctttttgtttttggcaaccgctttctcagccttatcttgtcaagggaagtgtcaggatgctgtggcacagatcaggtttcatagctttatgggaatttgttgaggagaatattgaccgaaca

SEQ ID NO: 552 - DNA, 200 bp, Amaranthus palmeri
tgttcggtcaatattctcctcaacaaattcccataaagctatgaaacctgatctgtgccacagcatcctgacacttcccttgacaagataaggctgagaaagcggttgccaaaaacaaaaaggagttaaataacataagaaaaattgttcaaatagcgataataataataataatcatcatcatacccaatgtatcccgc

SEQ ID NO: 553 - DNA, 200 bp, Amaranthus palmeri
tgttgaggagaatattgaccgaacaaatttttctgatgatctgactacaaacagtgggaaccatagtgagcgaaagtggggggccatggtcgttattaaaactcttcagttcttgccatcggtgattgctgcagcattgagagaaacaactcatagttccgatcaatcaacttccactggctctatagaatcagtcatcc

SEQ ID NO: 554 - DNA, 200 bp, Amaranthus palmeri
ggatgactgattctatagagccagtggaagttgattgatcggaactatgagttgtttctctcaatgctgcagcaatcaccgatggcaagaactgaagagttttaataacgaccatggccccccactttcgctcactatggttcccactgtttgtagtcagatcatcagaaaaatttgttcggtcaatattctcctcaaca

SEQ ID NO: 555 - DNA, 200 bp, Amaranthus palmeri
actggctctatagaatcagtcatccatggaaatatgctgcacattgcactagtgggggtgaacaaccagatgagcttgttgcaggataggtatataagactagcctgtaacatatggtgtaataatctttattatgtaaccttgtgcttctaatgtcctttatttctatggactatattgaagtacacttcttgttcatg

SEQ ID NO: 556 - DNA, 200 bp, Amaranthus palmeri
catgaacaagaagtgtacttcaatatagtccatagaaataaaggacattagaagcacaaggttacataataaagattattacaccatatgttacaggctagtcttatatacctatcctgcaacaagctcatctggttgttcacccccactagtgcaatgtgcagcatatttccatggatgactgattctatagagccagt

SEQ ID NO: 557 - DNA, 200 bp, Amaranthus palmeri
tattgaagtacacttcttgttcatgtgatgttgatgttgataattgctaccgggtcaatcgaaaacaacctctttgttatcacttgaggtgttcaaaatagacccgatgactcgatattcatcagatcttgtaactgaactcgacttcaaaatgaatttaaaattatataaaaatcaatatggacacaagaccggatatc

SEQ ID NO: 558 - DNA, 200 bp, Amaranthus palmeri
gatatccggtcttgtgtccatattgatttttatataattttaaattcattttgaagtcgagttcagttacaagatctgatgaatatcgagtcatcgggtctattttgaacacctcaagtgataacaaagaggttgttttcgattgacccggtagcaattatcaacatcaacatcacatgaacaagaagtgtacttcaata

SEQ ID NO: 559 - DNA, 200 bp, Amaranthus palmeri
caatatggacacaagaccggatatcaatccgacccgaaatagttgactcgaaatcaacttgatgatccgaatgaacacctctagttatcactaacaagggtcagattgcgtacatcaaacccctcaaatcctgcttaggtgggagcttgtcaatggcttaggggtaacgggaatgtgtgtgctatgtacattgtgcatct

SEQ ID NO: 560 - DNA, 200 bp, Amaranthus palmeri
agatgcacaatgtacatagcacacacattcccgttacccctaagccattgacaagctcccacctaagcaggatttgaggggtttgatgtacgcaatctgacccttgttagtgataactagaggtgttcattcggatcatcaagttgatttcgagtcaactatttcgggtcggattgatatccggtcttgtgtccatattg

SEQ ID NO: 561 - DNA, 200 bp, Amaranthus palmeri
tgtgtgctatgtacattgtgcatctattcttatacttatgttgagttttttggatcaaatataaagaacttaacttttgtattttcttgatgtggtgtagtggtgatgaagatcaggctcaagagagaatccataaattggccaaaattctgagagagcaagaagtgagttcagcccttcgtgctgctggtgttggtgtg

SEQ ID NO: 562 - DNA, 200 bp, Amaranthus palmeri
cacaccaacaccagcagcacgaagggctgaactcacttcttgctctctcagaattttggccaatttatggattctctcttgagcctgatcttcatcaccactacaccacatcaagaaaatacaaaagttaagttctttatatttgatccaaaaaactcaacataagtataagaatagatgcacaatgtacatagcacaca

SEQ ID NO: 563 - DNA, 200 bp, Amaranthus palmeri
ccttcgtgctgctggtgttggtgtgattagttgcatcatacagagagatgaagggcgaactccgatgaggcattcattctattggtcagcagaaaaacaatattatagtgaggagcctttactacgtcatttggaaccccctctatctatgtatctcgagctggtactagtctctgaaccgattgcctttcttctgcttt

SEQ ID NO: 564 - DNA, 200 bp, Amaranthus palmeri
aaagcagaagaaaggcaatcggttcagagactagtaccagctcgagatacatagatagagggggttccaaatgacgtagtaaaggctcctcactataatattgtttttctgctgaccaatagaatgaatgcctcatcggagttcgcccttcatctctctgtatgatgcaactaatcacaccaacaccagcagcacgaagg

SEQ ID NO: 565 - DNA, 200 bp, Amaranthus palmeri
gaaccgattgcctttcttctgctttgttattctgtgtgatatttcgacttaagtctaatttacatcgttttgtacatttgttatccaaagcacgttaaaagatacttccttcgtttttttacaagcacccaaacacctttttacgcagcccaattggtttgtcgggttgcttatatatagaattatactcaacttaaaaa

SEQ ID NO: 566 - DNA, 200 bp, Amaranthus palmeri
tttttaagttgagtataattctatatataagcaacccgacaaaccaattgggctgcgtaaaaaggtgtttgggtgcttgtaaaaaaacgaaggaagtatcttttaacgtgctttggataacaaatgtacaaaacgatgtaaattagacttaagtcgaaatatcacacagaataacaaagcagaagaaaggcaatcggttc

SEQ ID NO: 567 - DNA, 200 bp, Amaranthus palmeri
atggaggaagtataattatgcagccaaaattgatggcttttaacttttcatcaaatcaggacaagcttaagggttatgaagatatcaaatatactccttcccgtgatcgtcaatggcatctttacacagttattgataaaccattcattcggaggatgtttttgagaacccttgtaagacaacccatctctgagttcaca

SEQ ID NO: 568 - DNA, 200 bp, Amaranthus palmeri
tgtgaactcagagatgggttgtcttacaagggttctcaaaaacatcctccgaatgaatggtttatcaataactgtgtaaagatgccattgacgatcacgggaaggagtatatttgatatcttcataacccttaagcttgtcctgatttgatgaaaagttaaaagccatcaattttggctgcataattatacttcctccat

SEQ ID NO: 569 - DNA, 200 bp, Amaranthus palmeri
aagacaacccatctctgagttcacaggcgtcgaactaagcgctcttgaaacacaaaagcctatctctttcacttcaagaagcatcctaaggtccttaacaaccgccatggaggagttggagctcaatgcacatagtgcttcactgaaacccgatcacgctcatatgtacttgtacattgtccgagagcaacaaatatacg

SEQ ID NO: 570 - DNA, 200 bp, Amaranthus palmeri
cgtatatttgttgctctcggacaatgtacaagtacatatgagcgtgatcgggtttcagtgaagcactatgtgcattgagctccaactcctccatggcggttgttaaggaccttaggatgcttcttgaagtgaaagagataggcttttgtgtttcaagagcgcttagttcgacgcctgtgaactcagagatgggttgtctt

SEQ ID NO: 571 - DNA, 200 bp, Amaranthus palmeri
attgtccgagagcaacaaatatacgatcttgtgccatatcacaggtatctattgctgcgtgcctcaactttttttgtttattattggtcattagtacaccttattcttagaagaaacttttttcggccaattatttccagggaggtgaacatagatcaccaacaagaagaggcttcagttcaattctttttggaagatct

SEQ ID NO: 572 - DNA, 200 bp, Amaranthus palmeri
agatcttccaaaaagaattgaactgaagcctcttcttgttggtgatctatgttcacctccctggaaataattggccgaaaaaagtttcttctaagaataaggtgtactaatgaccaataataaacaaaaaaagttgaggcacgcagcaatagatacctgtgatatggcacaagatcgtatatttgttgctctcggacaat

SEQ ID NO: 573 - DNA, 200 bp, Amaranthus palmeri
cagttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatacctgttcggtacatgtaagtcataattttgagaac

SEQ ID NO: 574 - DNA, 200 bp, Amaranthus palmeri
gttctcaaaattatgacttacatgtaccgaacaggtatgaccagtcacattagtaactgccaccctccataaaccattagctttcccgggagatgatacccgaagtttcacttcccactcacaaacatttagtttatgcatccttacaccagcaagactatggatttcatgcgcgagatcttccaaaaagaattgaactg

SEQ ID NO: 575 - DNA, 200 bp, Amaranthus palmeri
acatgtaagtcataattttgagaacctcttttttgatcaagtcacaattttaatttttcacaaattcttgtatgagacggtctcaccgtgagaagcgccccatacttggattaaatagccgaataaaagaaacttttagcataatggaccttttgtatggactcgtctcatggtgagaaggtctcatacaataggggcaa

SEQ ID NO: 576 - DNA, 200 bp, Amaranthus palmeri
ttgcccctattgtatgagaccttctcaccatgagacgagtccatacaaaaggtccattatgctaaaagtttcttttattcggctatttaatccaagtatggggcgcttctcacggtgagaccgtctcatacaagaatttgtgaaaaattaaaattgtgacttgatcaaaaaagaggttctcaaaattatgacttacatgt

SEQ ID NO: 577 - DNA, 200 bp, Amaranthus palmeri
agaaggtctcatacaataggggcaattaatttttagcttcttatctgtaaattttgcatagtacatagttttgaattttgagaggttgagtctatgtgacaacgaatatttaattgagtataatgttgtttaatccaaatatgatataaaagggtgtggcataagtgattgagcattcttttttcttttcaatgggaagt

SEQ ID NO: 578 - DNA, 200 bp, Amaranthus palmeri
acttcccattgaaaagaaaaaagaatgctcaatcacttatgccacacccttttatatcatatttggattaaacaacattatactcaattaaatattcgttgtcacatagactcaacctctcaaaattcaaaactatgtactatgcaaaatttacagataagaagctaaaaattaattgcccctattgtatgagaccttct

SEQ ID NO: 579 - DNA, 200 bp, Amaranthus palmeri
ttcttttttcttttcaatgggaagttaaaggtctaaaccttggtataatttccttcaatgatgagcaatcaaagggattctaacctgtttatttatgactcgaaagtcgaacccaaaccagaacccgaacccgactcaacttgatttttttgacatgcctaaatggaactacagatgtattggggaaaataattaaacta

SEQ ID NO: 580 - DNA, 200 bp, Amaranthus palmeri
tagtttaattattttccccaatacatctgtagttccatttaggcatgtcaaaaaaatcaagttgagtcgggttcgggttctggtttgggttcgactttcgagtcataaataaacaggttagaatccctttgattgctcatcattgaaggaaattataccaaggtttagacctttaacttcccattgaaaagaaaaaagaa

SEQ ID NO: 581 - DNA, 200 bp, Amaranthus palmeri
tgtattggggaaaataattaaactagaaaatggggaaaataattaaactagaaaatggggaaaacaatttacctagaatatgttttcagccaaaacaaacactcccaaatacatttcttagcatccacaaatgccgaggaattgcaatggaactccagttcctcggttcaacttagagaagtatataattcttttttgca

SEQ ID NO: 582 - DNA, 200 bp, Amaranthus palmeri
tgcaaaaaagaattatatacttctctaagttgaaccgaggaactggagttccattgcaattcctcggcatttgtggatgctaagaaatgtatttgggagtgtttgttttggctgaaaacatattctaggtaaattgttttccccattttctagtttaattattttccccattttctagtttaattattttccccaataca

SEQ ID NO: 583 - DNA, 200 bp, Amaranthus palmeri
gagaagtatataattcttttttgcacgatatcattatggttaattgacctgttttttctatgaaatataatttaatttttatgctctctagtttgttttactacacatgaatagttttggtttagagtgatcattttcttacaatattgatgcccaggtttatcgtgaattggaagatagcaacctacatgaaatggtct

SEQ ID NO: 584 - DNA, 200 bp, Amaranthus palmeri
agaccatttcatgtaggttgctatcttccaattcacgataaacctgggcatcaatattgtaagaaaatgatcactctaaaccaaaactattcatgtgtagtaaaacaaactagagagcataaaaattaaattatatttcatagaaaaaacaggtcaattaaccataatgatatcgtgcaaaaaagaattatatacttctc

SEQ ID NO: 585 - DNA, 200 bp, Amaranthus palmeri
cataatacattaagtccagtatctatacaagagattaaaccagctacaaaaaagctgatgagcacaagatacatcaaacaaaaaccagcagctgatagcagtatttcctttttcttaatggcaagaatgcttgtctgtgctggcaacacgactccccaaagatctgagatacgaattggaatcaaaatctagagcttttg

SEQ ID NO: 586 - DNA, 200 bp, Amaranthus palmeri
caaaagctctagattttgattccaattcgtatctcagatctttggggagtcgtgttgccagcacagacaagcattcttgccattaagaaaaaggaaatactgctatcagctgctggtttttgtttgatgtatcttgtgctcatcagcttttttgtagctggtttaatctcttgtatagatactggacttaatgtattatg

SEQ ID NO: 587 - DNA, 200 bp, Amaranthus palmeri
ttggaatcaaaatctagagcttttgaagcgattaccaacaccccaaacatagaatttcctgctaagttgttgaaaagtattcttgaggaccatttaaactcatgccaagagaaagataaaggagctcaagagaggcttattgagcctcttatggttcttgtaaagtcttacgaaggtgggcgagaaagtcatgctcgttt

SEQ ID NO: 588 - DNA, 200 bp, Amaranthus palmeri
aaacgagcatgactttctcgcccaccttcgtaagactttacaagaaccataagaggctcaataagcctctcttgagctcctttatctttctcttggcatgagtttaaatggtcctcaagaatacttttcaacaacttagcaggaaattctatgtttggggtgttggtaatcgcttcaaaagctctagattttgattccaa

SEQ ID NO: 589 - DNA, 200 bp, Amaranthus palmeri
gtgggcgagaaagtcatgctcgttttattgttcaatctttatttgaagagtatttatccgttgaagaattgtttagcgacaatctccaggctgatgtgattgaacgtctccgccttcagtataagaaggatctgctgaagattgttgacattgtactgtcgcatcagggtgttaagaataaaaataagctgattctacga

SEQ ID NO: 590 - DNA, 200 bp, Amaranthus palmeri
tcgtagaatcagcttatttttattcttaacaccctgatgcgacagtacaatgtcaacaatcttcagcagatccttcttatactgaaggcggagacgttcaatcacatcagcctggagattgtcgctaaacaattcttcaacggataaatactcttcaaataaagattgaacaataaaacgagcatgactttctcgcccac

SEQ ID NO: 591 - DNA, 200 bp, Amaranthus palmeri
gaataaaaataagctgattctacgactcatggaacagctggtttacccaaatcccgctgcatacagggggcaacttatccgtttctctcaattgaaccatacaatgtattctgagttggcactaaaggccagtcaattgcttgaacaaacgaaattgagtgagctccgttcgaacattgctagaaacctctctgagctag

SEQ ID NO: 592 - DNA, 200 bp, Amaranthus palmeri
ctagctcagagaggtttctagcaatgttcgaacggagctcactcaatttcgtttgttcaagcaattgactggcctttagtgccaactcagaatacattgtatggttcaattgagagaaacggataagttgccccctgtatgcagcgggatttgggtaaaccagctgttccatgagtcgtagaatcagcttatttttattc

SEQ ID NO: 593 - DNA, 200 bp, Amaranthus palmeri
attgctagaaacctctctgagctagaaatgtttaccgaggatggcgaaaacatggatactccaaaaagaaaaagtgctattaatgaacgtatggaggcccttgtgagtactcctctagctgttgaagatgcccttgtcggtttgtttgatcatagtgatcatacacttcagaggcgggttgttgagacctatgttcggag

SEQ ID NO: 594 - DNA, 200 bp, Amaranthus palmeri
ctccgaacataggtctcaacaacccgcctctgaagtgtatgatcactatgatcaaacaaaccgacaagggcatcttcaacagctagaggagtactcacaagggcctccatacgttcattaatagcactttttctttttggagtatccatgttttcgccatcctcggtaaacatttctagctcagagaggtttctagcaat

SEQ ID NO: 595 - DNA, 200 bp, Amaranthus palmeri
aaagtggggggccatggtcgttattaaaactcttcagttcttgccatcggtgattgctgcagcattgagagaaacaactcatagttccgatcaatcaacttccactggctctatagaatcagtcatccatggaaatatgctgcacattgcactagtgggggtgaacaaccagatgagcttgttgcaggatagtggtgatg

SEQ ID NO: 596 - DNA, 200 bp, Amaranthus palmeri
catcaccactatcctgcaacaagctcatctggttgttcacccccactagtgcaatgtgcagcatatttccatggatgactgattctatagagccagtggaagttgattgatcggaactatgagttgtttctctcaatgctgcagcaatcaccgatggcaagaactgaagagttttaataacgaccatggccccccacttt

SEQ ID NO: 597 - DNA, 200 bp, Amaranthus palmeri
agcttgttgcaggatagtggtgatgaagatcaggctcaagagagaatcgataaattggccaaaattctgagagagcaagaagtgagttcagcccttcgtgctgctggtgttggtgtgattagttgcatcatacagagagatgaagggcgaactccgatgaggcattcattctattggtcagcagaaaaacaatattatag

SEQ ID NO: 598 - DNA, 200 bp, Amaranthus palmeri
ctataatattgtttttctgctgaccaatagaatgaatgcctcatcggagttcgcccttcatctctctgtatgatgcaactaatcacaccaacaccagcagcacgaagggctgaactcacttcttgctctctcagaattttggccaatttatcgattctctcttgagcctgatcttcatcaccactatcctgcaacaagct

SEQ ID NO: 599 - DNA, 200 bp, Amaranthus palmeri
ggtcagcagaaaaacaatattatagtgaggagcctttactacgtcatttggaaccccctctatctatgtatctcgagctggacaagcttaagggttatgaagatatcaaatatactccttcccgtgatcgtcaatggcatctttacacggttattgataaaccattcattcggaggatgtttttgagaacccttgtaaga

SEQ ID NO: 600 - DNA, 200 bp, Amaranthus palmeri
tcttacaagggttctcaaaaacatcctccgaatgaatggtttatcaataaccgtgtaaagatgccattgacgatcacgggaaggagtatatttgatatcttcataacccttaagcttgtccagctcgagatacatagatagagggggttccaaatgacgtagtaaaggctcctcactataatattgtttttctgctgacc

SEQ ID NO: 601 - DNA, 200 bp, Amaranthus palmeri
gatgtttttgagaacccttgtaagacaacccatctctgagttcacaggcgtcgaactaagcgctcttgaaacacaaaagcctatctctttcacttcaagaagcatcctaaggtccttaacaaccgccatggaggagttggagctcaatgcacatagtgcttcactgaaacccgatcacgctcatatgtacttgtacattg

SEQ ID NO: 602 - DNA, 200 bp, Amaranthus palmeri
caatgtacaagtacatatgagcgtgatcgggtttcagtgaagcactatgtgcattgagctccaactcctccatggcggttgttaaggaccttaggatgcttcttgaagtgaaagagataggcttttgtgtttcaagagcgcttagttcgacgcctgtgaactcagagatgggttgtcttacaagggttctcaaaaacatc

SEQ ID NO: 603 - DNA, 200 bp, Amaranthus palmeri
cacgctcatatgtacttgtacattgtccgagagcaacaaatatacgatcttgtgccatatcacagggaggtgaacatagatcaccaacaagaagaggcttcggttcaattctttttggaagatctcgcgcatgaaatccatagtcttgctggtgtaaggatgcataaactaaatgtttgtgagtgggaagtgaaacttcg

SEQ ID NO: 604 - DNA, 200 bp, Amaranthus palmeri
cgaagtttcacttcccactcacaaacatttagtttatgcatccttacaccagcaagactatggatttcatgcgcgagatcttccaaaaagaattgaaccgaagcctcttcttgttggtgatctatgttcacctccctgtgatatggcacaagatcgtatatttgttgctctcggacaatgtacaagtacatatgagcgtg

SEQ ID NO: 605 - DNA, 200 bp, Amaranthus palmeri
tttgtgagtgggaagtgaaacttcgggtatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccc

SEQ ID NO: 606 - DNA, 200 bp, Amaranthus palmeri
gggtgcattcacaggtaccccatggtgggggccgtgaacagatactgaatggtagaccatttcatgtaggttgctatcttccaattcacgataaacatgtaccgaacaggtatgaccagtcacattagtaactgccaccctccataaaccattagctttcccgggagatgatacccgaagtttcacttcccactcacaaa

SEQ ID NO: 607 - DNA, 200 bp, Amaranthus palmeri
ccatggggtacctgtgaatgcaccctatcaaccactcggtggcatcgcccgtaagcgacttcaggccatgaaaagtagcacaacttactgttacgattttccactggctttctcaactgccctgaagcaatcatgggcatcggaagctccggatgtcaagaaaccctcggacaaagcgcttttgaaagtaaccgagctta

SEQ ID NO: 608 - DNA, 200 bp, Amaranthus palmeri
taagctcggttactttcaaaagcgctttgtccgagggtttcttgacatccggagcttccgatgcccatgattgcttcagggcagttgagaaagccagtggaaaatcgtaacagtaagttgtgctacttttcatggcctgaagtcgcttacgggcgatgccaccgagtggttgatagggtgcattcacaggtaccccatgg

SEQ ID NO: 609 - DNA, 200 bp, Amaranthus palmeri
gcgcttttgaaagtaaccgagcttagcatttgctgatccaaaaggcacatggggaactccgcttgttccaataaatcgcaagcctggtatgaacgatgttggcatggtagcctggtacatggaaatgtccacccccgagttccctaacggaagaacaataatggttgtagctaatgatgttaccttcaaggccggatctt

SEQ ID NO: 610 - DNA, 200 bp, Amaranthus palmeri
aagatccggccttgaaggtaacatcattagctacaaccattattgttcttccgttagggaactcgggggtggacatttccatgtaccaggctaccatgccaacatcgttcataccaggcttgcgatttattggaacaagcggagttccccatgtgccttttggatcagcaaatgctaagctcggttactttcaaaagcgc

SEQ ID NO: 611 - DNA, 200 bp, Amaranthus palmeri
gatgttaccttcaaggccggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaatcccgagagtggatttca

SEQ ID NO: 612 - DNA, 200 bp, Amaranthus palmeri
tgaaatccactctcgggatttgactcatccgaccagccaactttaaagcaggattttagctcttcggcaacaccaagtcgagctcctgaattggcagccagataaataagaggaagtttcttcgcgcaagcaagatttgtaacagcaaggaagaaagcatcttctcgtggtccgaaagatccggccttgaaggtaacatc

SEQ ID NO: 613 - DNA, 200 bp, Amaranthus palmeri
agtcaaatcccgagagtggatttcagtatgtctacttaacccctgaagattacgatcgtataggatcgtcagtcatagcccacgagttaaaactcgaaagtggagaaaaaagatgggttatagataccgttgtaggtaaggaggacggattaggtgttgagaacctatcgggaagtggtgctatagccagtgcatactca

SEQ ID NO: 614 - DNA, 200 bp, Amaranthus palmeri
tgagtatgcactggctatagcaccacttcccgataggttctcaacacctaatccgtcctccttacctacaacggtatctataacccatcttttttctccactttcgagttttaactcgtgggctatgactgacgatcctatacgatcgtaatcttcaggggttaagtagacatactgaaatccactctcgggatttgact

SEQ ID NO: 615 - DNA, 200 bp, Amaranthus palmeri
tggtgctatagccagtgcatactcaagggcttacaaggaaacatttactctgacttttgtaaccggaagaacggtcggtattggtgcctatcttgctcgtcttgggatgcgttgtatacagaggcttgaccagcctataattctcacgggtttttctgctttaaataaacttctcggccgggaggtttatagttcacaca

SEQ ID NO: 616 - DNA, 200 bp, Amaranthus palmeri
tgtgtgaactataaacctcccggccgagaagtttatttaaagcagaaaaacccgtgagaattataggctggtcaagcctctgtatacaacgcatcccaagacgagcaagataggcaccaataccgaccgttcttccggttacaaaagtcagagtaaatgtttccttgtaagcccttgagtatgcactggctatagcacca

SEQ ID NO: 617 - DNA, 200 bp, Amaranthus palmeri
ggccgggaggtttatagttcacacatgcaacttggtggaccgaagattatgggcacaaacggggtagttcatcttacagtttccgatgatcttgaaggcatttcatctatcttgaagtggctgagctacgttccaccctattcaggtggtgaacttccgatttctcggtgtttagaccctccagaaagaccggttgcgta

SEQ ID NO: 618 - DNA, 200 bp, Amaranthus palmeri
tacgcaaccggtctttctggagggtctaaacaccgagaaatcggaagttcaccacctgaatagggtggaacgtagctcagccacttcaagatagatgaaatgccttcaagatcatcggaaactgtaagatgaactaccccgtttgtgcccataatcttcggtccaccaagttgcatgtgtgaactataaacctcccggcc

SEQ ID NO: 619 - DNA, 200 bp, Amaranthus palmeri
accctccagaaagaccggttgcgtatttgcctgaaaattcttgtgatcctcgtggtgctatatctggtacggttgactccaccggtaaatggttagggggtattttcgacaaagatagttttgtggaaaccttagaaggatgggcgcgaacagttgtcacgggaagggctaagctcggaggaattccagttggcatagtt

SEQ ID NO: 620 - DNA, 200 bp, Amaranthus palmeri
aactatgccaactggaattcctccgagcttagcccttcccgtgacaactgttcgcgcccatccttctaaggtttccacaaaactatctttgtcgaaaataccccctaaccatttaccggtggagtcaaccgtaccagatatagcaccacgaggatcacaagaattttcaggcaaatacgcaaccggtctttctggagggt

SEQ ID NO: 621 - DNA, 200 bp, Amaranthus palmeri
cggaggaattccagttggcatagttgccgttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactcccacttttcattttagcta

SEQ ID NO: 622 - DNA, 200 bp, Amaranthus palmeri
tagctaaaatgaaaagtgggagttcttcccggttgaaatccatcagcgcttgtgctgtcttggatgcggaatctgggaaccatacttgccctgcttgtggtacgactctctcgtgtgagtcgagttgaccgggatctgctgggattacttgcataacagtctgcgtctcaacggcaactatgccaactggaattcctccg

SEQ ID NO: 623 - DNA, 200 bp, Amaranthus palmeri
gaactcccacttttcattttagctaattggagaggtttctcgggtggacaaagggatctctttgaagggatccttcaggccggatccaccatagttgaaaatcttaggacttataatcaacccgtttttgtttatatccctatgatgggggagcttcgaggaggcgcatgggtggtcgtcgatagtcgaattaattccga

SEQ ID NO: 624 - DNA, 200 bp, Amaranthus palmeri
tcggaattaattcgactatcgacgaccacccatgcgcctcctcgaagctcccccatcatagggatataaacaaaaacgggttgattataagtcctaagattttcaactatggtggatccggcctgaaggatcccttcaaagagatccctttgtccacccgagaaacctctccaattagctaaaatgaaaagtgggagttc

SEQ ID NO: 625 - DNA, 200 bp, Amaranthus palmeri
tcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgatcaacaactcatcggtctcaaggaaaaactagccgaagccaagagctctaattcctacaat

SEQ ID NO: 626 - DNA, 200 bp, Amaranthus palmeri
attgtaggaattagagctcttggcttcggctagtttttccttgagaccgatgagttgttgatcaagccttcccatacactcgagaagttccttggttcggaacttaatctcgatcattccttccggttcaagcacatttcctttagctgtttggtcggcgtacatttctatatggtcggaattaattcgactatcgacga

SEQ ID NO: 627 - DNA, 200 bp, Amaranthus palmeri
agccaagagctctaattcctacaataaaatcgagcccctgcagcaacaaataaaagcccgcgagaagcaactattgcctctatatactcaaatagccaccaaatttgccgagttgcacgatacgtctttaaggatggctgccaaaggagttattagggacgtcttggaatggaaaagctcgcgttcgttcttttacaaaa

SEQ ID NO: 628 - DNA, 200 bp, Amaranthus palmeri
ttttgtaaaagaacgaacgcgagcttttccattccaagacgtccctaataactcctttggcagccatccttaaagacgtatcgtgcaactcggcaaatttggtggctatttgagtatatagaggcaatagttgcttctcgcgggcttttatttgttgctgcaggggctcgattttattgtaggaattagagctcttggct

SEQ ID NO: 629 - DNA, 200 bp, Amaranthus palmeri
agctcgcgttcgttcttttacaaaagattatacaggagagttatggaggaatcactcgtcaagactgttcgagatgctgcaggtgaacggttgacccataagtcggctttggagttgatccaaaaatggttcaatgagtcgaatatctccggagaggcttccgatgcttgggctgatgatgcggccttctttaagtggaa

SEQ ID NO: 630 - DNA, 200 bp, Amaranthus palmeri
ttccacttaaagaaggccgcatcatcagcccaagcatcggaagcctctccggagatattcgactcattgaaccatttttggatcaactccaaagccgacttatgggtcaaccgttcacctgcagcatctcgaacagtcttgacgagtgattcctccataactctcctgtataatcttttgtaaaagaacgaacgcgagct

SEQ ID NO: 631 - DNA, 200 bp, Amaranthus palmeri
atgatgcggccttctttaagtggaaggacgataccgccaactacgaggagaagttgaaagagttgcgcgttcagaaggtattggatcagctgtcgaatattggagattcggcaactaatttgagggctctgcctcagggtcttgctgccctacttcaaaaggtggatccatcgagtcgagaagaactagtcgaggaactc

SEQ ID NO: 632 - DNA, 200 bp, Amaranthus palmeri
gagttcctcgactagttcttctcgactcgatggatccaccttttgaagtagggcagcaagaccctgaggcagagccctcaaattagttgccgaatctccaatattcgacagctgatccaataccttctgaacgcgcaactctttcaacttctcctcgtagttggcggtatcgtccttccacttaaagaaggccgcatcat

SEQ ID NO: 633 - DNA, 200 bp, Amaranthus palmeri
tcgagaagaactagtcgaggaactccgtagagtgctcacttgatttcgcaaccgttgatggtgaagtgaaaccttcttggtttcatcatggtagaaaatattattaggcaaatctataattctagttacatccattgttttagacaatagtattgaactaatttatttaattaaattgtataaataggagaccttgaatt

SEQ ID NO: 634 - DNA, 200 bp, Amaranthus palmeri
aattcaaggtctcctatttatacaatttaattaaataaattagttcaatactattgtctaaaacaatggatgtaactagaattatagatttgcctaataatattttctaccatgatgaaaccaagaaggtttcacttcaccatcaacggttgcgaaatcaagtgagcactctacggagttcctcgactagttcttctcga

SEQ ID NO: 635 - DNA, 200 bp, Amaranthus palmeri
ggagacatcttgtgcctctaaccaaaccaaaccaacctccttaaacttctcttcttctactcaccattttttcctctttttattgattattgattattcattttaaatatacattatattgtaggaatttaatgaaattttcattaaattctgataaagttttgattttttttagtgtatgagatttttcttaagtaccc

SEQ ID NO: 636 - DNA, 200 bp, Amaranthus palmeri
gggtacttaagaaaaatctcatacactaaaaaaaatcaaaactttatcagaatttaatgaaaatttcattaaattcctacaatataatgtatatttaaaatgaataatcaataatcaataaaaagaggaaaaaatggtgagtagaagaagagaagtttaaggaggttggtttggtttggttagaggcacaagatgtctcc

SEQ ID NO: 637 - DNA, 200 bp, Amaranthus palmeri
tgtatgagatttttcttaagtacccaaatggtaaatttcaagtataatcaagttttttagtacccaaagctctaaatgttacttaaagttttgatcttttaatggtttcttctatttaatccaataatttaaagtacccagatttcaatttttagaataaattgagtttttgaattgcccaagttgtaattgttgctgaa

SEQ ID NO: 638 - DNA, 200 bp, Amaranthus palmeri
ttcagcaacaattacaacttgggcaattcaaaaactcaatttattctaaaaattgaaatctgggtactttaaattattggattaaatagaagaaaccattaaaagatcaaaactttaagtaacatttagagctttgggtactaaaaaacttgattatacttgaaatttaccatttgggtacttaagaaaaatctcataca

SEQ ID NO: 639 - DNA, 200 bp, Amaranthus palmeri
tgcccaagttgtaattgttgctgaattctcttgctttgatttgggttttctgattctatcccttctgattcatacaggtattctgattttttcttgcttgattactttttgttagtgtatggttgagctaatttagtttatagtagtgtgaattttattttattttttttcaattttttcaattatttcaatttgtagag

SEQ ID NO: 640 - DNA, 200 bp, Amaranthus palmeri
ctctacaaattgaaataattgaaaaaattgaaaaaaaataaaataaaattcacactactataaactaaattagctcaaccatacactaacaaaaagtaatcaagcaagaaaaaatcagaatacctgtatgaatcagaagggatagaatcagaaaacccaaatcaaagcaagagaattcagcaacaattacaacttgggca

SEQ ID NO: 641 - DNA, 200 bp, Amaranthus palmeri
ttttcaattatttcaatttgtagagtagattctcctattatgatttgtttttgtagctgggttttaatttttattgtctgatgatttatcttagcaatgttttattgaagtgtattttagttgattccatttttccaatagagtgtacaaaatcgacctgattaactgaaactgagtattatccaacgggaacaatcact

SEQ ID NO: 642 - DNA, 200 bp, Amaranthus palmeri
agtgattgttcccgttggataatactcagtttcagttaatcaggtcgattttgtacactctattggaaaaatggaatcaactaaaatacacttcaataaaacattgctaagataaatcatcagacaataaaaattaaaacccagctacaaaaacaaatcataataggagaatctactctacaaattgaaataattgaaaa

SEQ ID NO: 643 - DNA, 200 bp, Amaranthus palmeri
gtattatccaacgggaacaatcactgttacaaaattcaaattagaatgtcaagtaccgaaatcaacccgaccccacatattatacccgagatccacccgaacacccgaatgaacacctctgagatcatagagaggatataagaaaagtgaaactagaatggggaatttagtttatttaagctacattgagcaaaaatttt

SEQ ID NO: 644 - DNA, 200 bp, Amaranthus palmeri
aaaatttttgctcaatgtagcttaaataaactaaattccccattctagtttcacttttcttatatcctctctatgatctcagaggtgttcattcgggtgttcgggtggatctcgggtataatatgtggggtcgggttgatttcggtacttgacattctaatttgaattttgtaacagtgattgttcccgttggataatac

SEQ ID NO: 645 - DNA, 200 bp, Amaranthus palmeri
ttaagctacattgagcaaaaatttttttagtgactgattattgtagctggcttttgttgtataactcatctaagcaatgtttttgatgtgtgtgcagtagcattggattgttttgatttttttgttatattgtctatacaattcaattcttgaatcacacttgacttttagttccattttcatcttcacaaattcttgtg

SEQ ID NO: 646 - DNA, 200 bp, Amaranthus palmeri
cacaagaatttgtgaagatgaaaatggaactaaaagtcaagtgtgattcaagaattgaattgtatagacaatataacaaaaaaatcaaaacaatccaatgctactgcacacacatcaaaaacattgcttagatgagttatacaacaaaagccagctacaataatcagtcactaaaaaaatttttgctcaatgtagcttaa

SEQ ID NO: 647 - DNA, 200 bp, Amaranthus palmeri
attttcatcttcacaaattcttgtgagagacggtctcagtgttagacgctctctgtacatgggctaaatagcccaactaatacaactattagcatacgagcttcttattttgaagtcatctctcataagagtagctctctatctttcgttgggtagatggtaataaacggtagtaatgaggatgaaaaacaagtgtaatt

SEQ ID NO: 648 - DNA, 200 bp, Amaranthus palmeri
aattacacttgtttttcatcctcattactaccgtttattaccatctacccaacgaaagatagagagctactcttatgagagatgacttcaaaataagaagctcgtatgctaatagttgtattagttgggctatttagcccatgtacagagagcgtctaacactgagaccgtctctcacaagaatttgtgaagatgaaaat

SEQ ID NO: 649 - DNA, 200 bp, Amaranthus palmeri
atgaggatgaaaaacaagtgtaattttggttggaaaatatgttggttaccttgatggtcatgcttgtccaacttaaatcatcttattttcttctcaaaattcatttcaatgcattaccattaggagaggtgatattaggcggtaatgaaattatgtaaacaaaaaaacttttttgtgattgaagtttcattgctatagga

SEQ ID NO: 650 - DNA, 200 bp, Amaranthus palmeri
tcctatagcaatgaaacttcaatcacaaaaaagtttttttgtttacataatttcattaccgcctaatatcacctctcctaatggtaatgcattgaaatgaattttgagaagaaaataagatgatttaagttggacaagcatgaccatcaaggtaaccaacatattttccaaccaaaattacacttgtttttcatcctcat

SEQ ID NO: 651 - DNA, 200 bp, Amaranthus palmeri
gttgcagcattgcatagccgtgattgcagtgtccaaaggcggcaccaaaagatcattgaagaaggcccaataacgatagctccaccagaaacggtgaagaagcttgagcaagcagctagaagattggctttatgtgtgggttatgttggcgcagctacagttgaatatttatacagcatggaaacaggcgagttccattt

SEQ ID NO: 652 - DNA, 200 bp, Amaranthus palmeri
aaatggaactcgcctgtttccatgctgtataaatattcaactgtagctgcgccaacataacccacacataaagccaatcttctagctgcttgctcaagcttcttcaccgtttctggtggagctatcgttattgggccttcttcaatgatcttttggtgccgcctttggacactgcaatcacggctatgcaatgctgcaac

SEQ ID NO: 653 - DNA, 200 bp, Amaranthus palmeri
gcatggaaacaggcgagttccatttccttgagttgaatcctcggttacaggtggagcatcctgttactgagtggattgctgaggtaaatcttccagctgctcaagttgcagttggcatgggtatcccactttggcaaattcctgaaatccgtcggttctatgggaaggaacatggtgggggttatgatacttggatgagg

SEQ ID NO: 654 - DNA, 200 bp, Amaranthus palmeri
cctcatccaagtatcataacccccaccatgttccttcccatagaaccgacggatttcaggaatttgccaaagtgggatacccatgccaactgcaacttgagcagctggaagatttacctcagcaatccactcagtaacaggatgctccacctgtaaccgaggattcaactcaaggaaatggaactcgcctgtttccatgc

SEQ ID NO: 655 - DNA, 200 bp, Amaranthus palmeri
tgggggttatgatacttggatgaggacatctgctttggctactgcttttgattttaacgaggcacagtcggtgaaacctaaaggtcattgtattgctgcgcgtgtgacaagtgaggatcccgatgacggttttaagcctacaagcgggaaagtacaggagctgagttttaaaagtaaaccgaatgtgtgggcctacttct

SEQ ID NO: 656 - DNA, 200 bp, Amaranthus palmeri
agaagtaggcccacacattcggtttacttttaaaactcagctcctgtactttcccgcttgtaggcttaaaaccgtcatcgggatcctcacttgtcacacgcgcagcaatacaatgacctttaggtttcaccgactgtgcctcgttaaaatcaaaagcagtagccaaagcagatgtcctcatccaagtatcataaccccca

SEQ ID NO: 657 - DNA, 200 bp, Amaranthus palmeri
aaaccgaatgtgtgggcctacttctctgttaagtctgggggaggcattcatgagttctcggattctcaatttggccatgtttttgcatttggtgaaaaccgaggtttggccatagcaaatatgattcttggattaaaagaaattcaaattcgtggagaaattcgaactaatgttgattacaccatcgatcttttaaattg

SEQ ID NO: 658 - DNA, 200 bp, Amaranthus palmeri
caatttaaaagatcgatggtgtaatcaacattagttcgaatttctccacgaatttgaatttcttttaatccaagaatcatatttgctatggccaaacctcggttttcaccaaatgcaaaaacatggccaaattgagaatccgagaactcatgaatgcctcccccagacttaacagagaagtaggcccacacattcggttt

SEQ ID NO: 659 - DNA, 200 bp, Amaranthus palmeri
attacaccatcgatcttttaaattgtttggattatagagaaaaccaaattcatacaggttggttggatagtagaattgcgatgagggtcagagctgaaaggccaccttggtacatctctgttgtgggaggagggctttacaaagcatcgactagtagtgcagcgactgtttcagagtatataggctatcttgaaaaaggt

SEQ ID NO: 660 - DNA, 200 bp, Amaranthus palmeri
acctttttcaagatagcctatatactctgaaacagtcgctgcactactagtcgatgctttgtaaagccctcctcccacaacagagatgtaccaaggtggcctttcagctctgaccctcatcgcaattctactatccaaccaacctgtatgaatttggttttctctataatccaaacaatttaaaagatcgatggtgtaat

SEQ ID NO: 661 - DNA, 200 bp, Amaranthus palmeri
gtatataggctatcttgaaaaaggtcaaattcctccgaagcatatatcactcgtccactatgaagttgctctaaatatcgaggggatgaaatataccattgagatgattaggggtggaccaggaagctacaaaatgtggttgaatgggtccgtagttgaggcggaaatacatactttaagagatgggggtctcttgatgc

SEQ ID NO: 662 - DNA, 200 bp, Amaranthus palmeri
gcatcaagagacccccatctcttaaagtatgtatttccgcctcaactacggacccattcaaccacattttgtagcttcctggtccacccctaatcatctcaatggtatatttcatcccctcgatatttagagcaacttcatagtggacgagtgatatatgcttcggaggaatttgacctttttcaagatagcctatatac

SEQ ID NO: 663 - DNA, 200 bp, Amaranthus palmeri
ttaagagatgggggtctcttgatgcagttggacggaaacagccatgtgatatatgccgaggaagaagctgcaggaactcgccttctgattgatggaagaacttgtttgcttcagaacgatcacgatccttcaaagctaattgcggagactccgtgtaagcttatgcggtatttggtaccagataacagtcacatagatgc

SEQ ID NO: 664 - DNA, 200 bp, Amaranthus palmeri
gcatctatgtgactgttatctggtaccaaataccgcataagcttacacggagtctccgcaattagctttgaaggatcgtgatcgttctgaagcaaacaagttcttccatcaatcagaaggcgagttcctgcagcttcttcctcggcatatatcacatggctgtttccgtccaactgcatcaagagacccccatctcttaa

SEQ ID NO: 665 - DNA, 200 bp, Amaranthus palmeri
taccagataacagtcacatagatgcagatactccgtatgctgaagttgaggtcatgaagatgtgtatgcctttgctttcccctgcatccggtgttttacaatttaagatgtccgaaggtcaagctatgcaggctggtgaactcatagctagtctagagttggatgatccttcagctgtaagaaaagccgaacctttcagt

SEQ ID NO: 666 - DNA, 200 bp, Amaranthus palmeri
actgaaaggttcggcttttcttacagctgaaggatcatccaactctagactagctatgagttcaccagcctgcatagcttgaccttcggacatcttaaattgtaaaacaccggatgcaggggaaagcaaaggcatacacatcttcatgacctcaacttcagcatacggagtatctgcatctatgtgactgttatctggta

SEQ ID NO: 667 - DNA, 200 bp, Amaranthus palmeri
tttttttttccttccaaatttctgatctttagagttttagtgatagatttatatacgtctctatccctcaggtgaaaattcctgctgagagttgcctagacgtaattcccgatgaagtatataaagcggcatgtgtttttactacagaggaagcaattgctagctgtcaagttgttggttatccggctatgatcaaagct

SEQ ID NO: 668 - DNA, 200 bp, Amaranthus palmeri
agctttgatcatagccggataaccaacaacttgacagctagcaattgcttcctctgtagtaaaaacacatgccgctttatatacttcatcgggaattacgtctaggcaactctcagcaggaattttcacctgagggatagagacgtatataaatctatcactaaaactctaaagatcagaaatttggaaggaaaaaaaaa

SEQ ID NO: 669 - DNA, 200 bp, Amaranthus palmeri
tggttatccggctatgatcaaagcttcttggggtggtggagggaagggaataagaaaggtaaaatttttttggatgatgatgctcttaaaagactaaaaggaggttacacatatccccattacttgtttatcatcagaggcggagcaaaaattgacaaagatttaaaggctgtgtgcaatttcaaaaaatatgatatatt

SEQ ID NO: 670 - DNA, 200 bp, Amaranthus palmeri
aatatatcatattttttgaaattgcacacagcctttaaatctttgtcaatttttgctccgcctctgatgataaacaagtaatggggatatgtgtaacctccttttagtcttttaagagcatcatcatccaaaaaaattttacctttcttattcccttccctccaccaccccaagaagctttgatcatagccggataacca

SEQ ID NO: 671 - DNA, 200 bp, Amaranthus palmeri
gcaatttcaaaaaatatgatatatttctaacaacgtatcttcaaacactttaaacatactacctattctaatattgcggcccctatttttttgaggccgtgtgtggtcgaacatattgaatatgcttagaaccactcctgtttatcactaatatgccatcttccacaatcaaacctctacttttgacccagattccttga

SEQ ID NO: 672 - DNA, 200 bp, Amaranthus palmeri
tcaaggaatctgggtcaaaagtagaggtttgattgtggaagatggcatattagtgataaacaggagtggttctaagcatattcaatatgttcgaccacacacggcctcaaaaaaataggggccgcaatattagaataggtagtatgtttaaagtgtttgaagatacgttgttagaaatatatcatattttttgaaattgc

SEQ ID NO: 673 - DNA, 200 bp, Amaranthus palmeri
tctacttttgacccagattccttgaaagggatttcgatttagactcgagctatggtcaattattagcaatagcaaaagcttcttaatagttaatagattctcaaacacttccgtcatgccaacactttatgaagactcatgggtattctctcttttaggttcataatgatgacgaagtacgggcattatttaagcaagtg

SEQ ID NO: 674 - DNA, 200 bp, Amaranthus palmeri
cacttgcttaaataatgcccgtacttcgtcatcattatgaacctaaaagagagaatacccatgagtcttcataaagtgttggcatgacggaagtgtttgagaatctattaactattaagaagcttttgctattgctaataattgaccatagctcgagtctaaatcgaaatccctttcaaggaatctgggtcaaaagtaga

SEQ ID NO: 675 - DNA, 200 bp, Amaranthus palmeri
agtacgggcattatttaagcaagtgcagggtgaagttcccggctcacccatatttataatgaaggtggcttcacaggttagactttcttcaacattggtccgatattcgagtaaattgcattaaaaaaggttaaatatacaatttttttggataagtattgtatgagagactactactaagataaagtattattaatatg

SEQ ID NO: 676 - DNA, 200 bp, Amaranthus palmeri
catattaataatactttatcttagtagtagtctctcatacaatacttatccaaaaaaattgtatatttaaccttttttaatgcaatttactcgaatatcggaccaatgttgaagaaagtctaacctgtgaagccaccttcattataaatatgggtgagccgggaacttcaccctgcacttgcttaaataatgcccgtact

SEQ ID NO: 677 - DNA, 200 bp, Amaranthus palmeri
actaagataaagtattattaatatgtgcagagtcgacacttagaagtacagttactgtgtgatgaatatggcaatgttgcagcattgcatagccgtgattgcagtgtccaaaggcggcaccaaaaggtgggtctttggtagattatggttatgatctacggtttcttattgtttaagaaaaatatttgatattaagcatt

SEQ ID NO: 678 - DNA, 200 bp, Amaranthus palmeri
aatgcttaatatcaaatatttttcttaaacaataagaaaccgtagatcataaccataatctaccaaagacccaccttttggtgccgcctttggacactgcaatcacggctatgcaatgctgcaacattgccatattcatcacacagtaactgtacttctaagtgtcgactctgcacatattaataatactttatcttagt

SEQ ID NO: 679 - DNA, 200 bp, Amaranthus rudis
aagaacttgtttgcttcagaacgatcacgatccttcaaagctgattgcggagacaccgtgtaagcttatgcggtatttggtaccagataacagtcacatagatgcagatactccgtatgctgaagttgaggtcatgaagatgtgtatgcctttgctttcccctgcatccggtgttttacaatttaagatgtccgaaggtc

SEQ ID NO: 680 - DNA, 200 bp, Amaranthus rudis
gaccttcggacatcttaaattgtaaaacaccggatgcaggggaaagcaaaggcatacacatcttcatgacctcaacttcagcatacggagtatctgcatctatgtgactgttatctggtaccaaataccgcataagcttacacggtgtctccgcaatcagctttgaaggatcgtgatcgttctgaagcaaacaagttctt

SEQ ID NO: 681 - DNA, 200 bp, Amaranthus rudis
ttacaatttaagatgtccgaaggtcaagctatgcaggctggtgaactcatagctagtctagagttggatgatccttcagctgtaagaaaagccgaacctttccgtggaagctttcctgtcatgggcgcaccaactgcaatatctggaaaagttcatcagaggtgtgccgcaagtttaaatgccactcggatgattttggc

SEQ ID NO: 682 - DNA, 200 bp, Amaranthus rudis
gccaaaatcatccgagtggcatttaaacttgcggcacacctctgatgaacttttccagatattgcagttggtgcgcccatgacaggaaagcttccacggaaaggttcggcttttcttacagctgaaggatcatccaactctagactagctatgagttcaccagcctgcatagcttgaccttcggacatcttaaattgtaa

SEQ ID NO: 683 - DNA, 200 bp, Amaranthus rudis
taaatgccactcggatgattttggctggttatgaacacaatatagatgaagtagtacagagtttgctggaatgccttgatagtcccgaacttccattccttcaatggcaagaatgcttgtctgtgctggcaacacgacttcccaaagatctgagatacgaattggaatcaaaatctagagcttttgaagggattaccaac

SEQ ID NO: 684 - DNA, 200 bp, Amaranthus rudis
gttggtaatcccttcaaaagctctagattttgattccaattcgtatctcagatctttgggaagtcgtgttgccagcacagacaagcattcttgccattgaaggaatggaagttcgggactatcaaggcattccagcaaactctgtactacttcatctatattgtgttcataaccagccaaaatcatccgagtggcattta

SEQ ID NO: 685 - DNA, 200 bp, Amaranthus rudis
tagagcttttgaagggattaccaacacccagaacgtagaatttcctgctaagttgttgaaaagcattcttgaggaccatttaaactcatgccacgagaaagataaaggagctcaagagaggcttattgagcctcttatggctcttgtaaagtcttacgaaggtgggcgagaaagtcatgctcgttttattgttcaatctt

SEQ ID NO: 686 - DNA, 200 bp, Amaranthus rudis
aagattgaacaataaaacgagcatgactttctcgcccaccttcgtaagactttacaagagccataagaggctcaataagcctctcttgagctcctttatctttctcgtggcatgagtttaaatggtcctcaagaatgcttttcaacaacttagcaggaaattctacgttctgggtgttggtaatcccttcaaaagctcta

SEQ ID NO: 687 - DNA, 200 bp, Amaranthus rudis
catgctcgttttattgttcaatctttatttgaagagtatttatccgttgaagaattgtttagcgacaatctccaggctgatgtgattgaacgtctccgccttcagtataagaaggatctgctgaagattgttgacattgtactgtcgcatcagggtgttaagaataaaaataagctgattctacgactcatggaacagct

SEQ ID NO: 688 - DNA, 200 bp, Amaranthus rudis
agctgttccatgagtcgtagaatcagcttatttttattcttaacaccctgatgcgacagtacaatgtcaacaatcttcagcagatccttcttatactgaaggcggagacgttcaatcacatcagcctggagattgtcgctaaacaattcttcaacggataaatactcttcaaataaagattgaacaataaaacgagcatg

SEQ ID NO: 689 - DNA, 200 bp, Amaranthus rudis
tgattctacgactcatggaacagctggtttacccaaatcccgctgcatacagggggaaacttatccgtttctctcaattgaaccatacaatgtattctgagttggcactaaaggccagtcaattgcttgaacaaacgaaattgagtgagctccgttcgaacattgctagaaacctctctgagctagaaatgtttaccgag

SEQ ID NO: 690 - DNA, 200 bp, Amaranthus rudis
ctcggtaaacatttctagctcagagaggtttctagcaatgttcgaacggagctcactcaatttcgtttgttcaagcaattgactggcctttagtgccaactcagaatacattgtatggttcaattgagagaaacggataagtttccccctgtatgcagcgggatttgggtaaaccagctgttccatgagtcgtagaatca

SEQ ID NO: 691 - DNA, 200 bp, Amaranthus rudis
ctctgagctagaaatgtttaccgaggatggcgaaaacatggatactccaaaaagaaaaagtgctattaatgaacgtatggaggcgcttgtgagtactcctctagctgtcgaagatgcccttgttggtttgtttgatcatagtgatcatacacttcagaggcgggttgttgagacctatgttcggaggctttatcagcctt

SEQ ID NO: 692 - DNA, 200 bp, Amaranthus rudis
aaggctgataaagcctccgaacataggtctcaacaacccgcctctgaagtgtatgatcactatgatcaaacaaaccaacaagggcatcttcgacagctagaggagtactcacaagcgcctccatacgttcattaatagcactttttctttttggagtatccatgttttcgccatcctcggtaaacatttctagctcagag

SEQ ID NO: 693 - DNA, 200 bp, Amaranthus rudis
tatgttcggaggctttatcagccttatcttgtcaagggaagtgtcaggatgctgtggcacagatcaggcttcatagctttatgggaatttgttgaggagaatattgaccgaacgaatttttctgatctgactacaaacagtgggaaccatagtgagcgaaagtggggggccatggtcgttattaaaactcttcagttctt

SEQ ID NO: 694 - DNA, 200 bp, Amaranthus rudis
aagaactgaagagttttaataacgaccatggccccccactttcgctcactatggttcccactgtttgtagtcagatcagaaaaattcgttcggtcaatattctcctcaacaaattcccataaagctatgaagcctgatctgtgccacagcatcctgacacttcccttgacaagataaggctgataaagcctccgaacata

SEQ ID NO: 695 - DNA, 200 bp, Amaranthus rudis
tcgttattaaaactcttcagttcttgccatcggtaattgctgcagcattgagagaaacaactcatagttccgatcaatcaacttccactggctctatagaatcagtcatccatggaaatatgctgcacattgcactagtcggggtgaataaccagatgagcttgttgcaggatagtggtgatgaagatcaggctcaagag

SEQ ID NO: 696 - DNA, 200 bp, Amaranthus rudis
ctcttgagcctgatcttcatcaccactatcctgcaacaagctcatctggttattcaccccgactagtgcaatgtgcagcatatttccatggatgactgattctatagagccagtggaagttgattgatcggaactatgagttgtttctctcaatgctgcagcaattaccgatggcaagaactgaagagttttaataacga

SEQ ID NO: 697 - DNA, 200 bp, Amaranthus rudis
tggtgatgaagatcaggctcaagagagaatcgataagttggccaaaattctgagagaacaagaagtgagttcagcccttcgtgctgttggtgttggtgtgattagttgcatcatacagagagatgaagggcgaactccgatgaggcattcattctattggtcagcagaaaaacaatattatagtgaggaacctttactac

SEQ ID NO: 698 - DNA, 200 bp, Amaranthus rudis
gtagtaaaggttcctcactataatattgtttttctgctgaccaatagaatgaatgcctcatcggagttcgcccttcatctctctgtatgatgcaactaatcacaccaacaccaacagcacgaagggctgaactcacttcttgttctctcagaattttggccaacttatcgattctctcttgagcctgatcttcatcacca

SEQ ID NO: 699 - DNA, 200 bp, Amaranthus rudis
tattatagtgaggaacctttactacgtcatttggaaccccctctatctatgtatctcgagctggacaagcttaagggttatgaagatatcaaatatactccttcccgtgatcgtcaatggcatctttacacggttattgataaaccattcattcggaggatgtttttgagaacccttgtaagacaacccatctccgagtt

SEQ ID NO: 700 - DNA, 200 bp, Amaranthus rudis
aactcggagatgggttgtcttacaagggttctcaaaaacatcctccgaatgaatggtttatcaataaccgtgtaaagatgccattgacgatcacgggaaggagtatatttgatatcttcataacccttaagcttgtccagctcgagatacatagatagagggggttccaaatgacgtagtaaaggttcctcactataata

SEQ ID NO: 701 - DNA, 200 bp, Amaranthus rudis
ttgtaagacaacccatctccgagttcactggcgtcgaactaagcgctcttgaaacacaaaagcctatctcttttacttcaagaagcatcctaaggtcattaacaaccgccatggaggagttggagctcaatgcacatagtgcttcactgaaacccgatcacgctcatatgtacttgtacattgtccgagagcaacaaata

SEQ ID NO: 702 - DNA, 200 bp, Amaranthus rudis
tatttgttgctctcggacaatgtacaagtacatatgagcgtgatcgggtttcagtgaagcactatgtgcattgagctccaactcctccatggcggttgttaatgaccttaggatgcttcttgaagtaaaagagataggcttttgtgtttcaagagcgcttagttcgacgccagtgaactcggagatgggttgtcttacaa

SEQ ID NO: 703 - DNA, 200 bp, Amaranthus rudis
gtacattgtccgagagcaacaaatatacgatcttgtgccatataacagggaggtgaacatagattaccaacaagaagaggcttcggttcaattctttttggaagatctcgcgcatgaaatccatagtcttgctggtgtaaggatgcataaactaaatgtttgtgagtgggaagtgaaacttcggatatcatctcccggga

SEQ ID NO: 704 - DNA, 200 bp, Amaranthus rudis
tcccgggagatgatatccgaagtttcacttcccactcacaaacatttagtttatgcatccttacaccagcaagactatggatttcatgcgcgagatcttccaaaaagaattgaaccgaagcctcttcttgttggtaatctatgttcacctccctgttatatggcacaagatcgtatatttgttgctctcggacaatgtac

SEQ ID NO: 705 - DNA, 200 bp, Amaranthus rudis
aaacttcggatatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtgg

SEQ ID NO: 706 - DNA, 200 bp, Amaranthus rudis
ccaccgagtggttgatagggtgcattcacaggtaccccatggtgggggccgtgaacagatactgaatggtagaccatttcatgtaggttgctatcttccaattcacgataaacatgtaccgaacaggtatgaccagtcacattagtaactgccaccctccataaaccattagctttcccgggagatgatatccgaagttt

SEQ ID NO: 707 - DNA, 200 bp, Amaranthus rudis
atgcaccctatcaaccactcggtggcatctcccgtaagcgacttcaggccatgaagagtagcacaacatactgttacgattttccactggctttctcaactgccctgaagcaatcatgggcatcggaagctccggatgtcaagaaaccctcggacaaagcacttttgaaagtaaccgagctagcatttgctgatccaaaa

SEQ ID NO: 708 - DNA, 200 bp, Amaranthus rudis
ttttggatcagcaaatgctagctcggttactttcaaaagtgctttgtccgagggtttcttgacatccggagcttccgatgcccatgattgcttcagggcagttgagaaagccagtggaaaatcgtaacagtatgttgtgctactcttcatggcctgaagtcgcttacgggagatgccaccgagtggttgatagggtgcat

SEQ ID NO: 709 - DNA, 200 bp, Amaranthus rudis
cgagctagcatttgctgatccaaaaggcacatggggaactccgcttgttccaataaatcgcaagcctggtatgaacgatgttggcatggtagcctggtacttggaaatgtccacccccgagttccctaacggaagaacaataatggttgtagctaatgatgttaccttcaaggccggatctttcggaccacgagaagatg

SEQ ID NO: 710 - DNA, 200 bp, Amaranthus rudis
catcttctcgtggtccgaaagatccggccttgaaggtaacatcattagctacaaccattattgttcttccgttagggaactcgggggtggacatttccaagtaccaggctaccatgccaacatcgttcataccaggcttgcgatttattggaacaagcggagttccccatgtgccttttggatcagcaaatgctagctcg

SEQ ID NO: 711 - DNA, 200 bp, Amaranthus rudis
ggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaaccccgagagtggatttcagtatgtctacttaacccc

SEQ ID NO: 712 - DNA, 200 bp, Amaranthus rudis
ggggttaagtagacatactgaaatccactctcggggtttgactcatccgaccagccaactttaaagcaggattttagctcttcggcaacaccaagtcgagctcctgaattggcagccagataaataagaggaagtttcttcgcgcaagcaagatttgtaacagcaaggaagaaagcatcttctcgtggtccgaaagatcc

SEQ ID NO: 713 - DNA, 200 bp, Amaranthus rudis
gatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgctatagccagtgcatactcaagggcttacaaggaaaca

SEQ ID NO: 714 - DNA, 200 bp, Amaranthus rudis
tgtttccttgtaagcccttgagtatgcactggctatagcaccacttcctgatagattctcgacacctaatccgtcctccttaccgacaacggtgtctataacccatcttttttctccactttcgagttttaactcgtgggctatgactgacgatcctatacgatcgtaatcttcaggggttaagtagacatactgaaatc

SEQ ID NO: 715 - DNA, 200 bp, Amaranthus rudis
atactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcgggaggtttacagttcacacatgcaacttggtggaccga

SEQ ID NO: 716 - DNA, 200 bp, Amaranthus rudis
tcggtccaccaagttgcatgtgtgaactgtaaacctcccgaccgagaagtttatttaacgcagaaaaacccgtgagaattataggctggtcaagcctctgtatacaacgcatcccaagacgagcaagataggcaccaataccgaccgttctaccggttacaaaagtcagagtaaatgtttccttgtaagcccttgagtat

SEQ ID NO: 717 - DNA, 200 bp, Amaranthus rudis
tcacacatgcaacttggtggaccgaagattaatgggcacaaacggggtagttcatcttacagtttccgatgatcttgaaggcatttcatctatcttgaagtggctgagctatgttccaccctattcaggtggtgaacttccgatttctcggtgtttagaccctcccgaaagaccggttgcgtatttgcctgaaaattgtt

SEQ ID NO: 718 - DNA, 200 bp, Amaranthus rudis
aacaattttcaggcaaatacgcaaccggtctttcgggagggtctaaacaccgagaaatcggaagttcaccacctgaatagggtggaacatagctcagccacttcaagatagatgaaatgccttcaagatcatcggaaactgtaagatgaactaccccgtttgtgcccattaatcttcggtccaccaagttgcatgtgtga

SEQ ID NO: 719 - DNA, 200 bp, Amaranthus rudis
gttgcgtatttgcctgaaaattgttgtgatcctcgtggggctatatctggtacggttgactccgccggtaaatggtttgggggtattttcgacaaggatagttttgtggaaaccttagaaggatgggcacgaacagttgtcacgggaagggctaaactcggaggaattccagttggcatagttgctgttgagacacagac

SEQ ID NO: 720 - DNA, 200 bp, Amaranthus rudis
gtctgtgtctcaacagcaactatgccaactggaattcctccgagtttagcccttcccgtgacaactgttcgtgcccatccttctaaggtttccacaaaactatccttgtcgaaaatacccccaaaccatttaccggcggagtcaaccgtaccagatatagccccacgaggatcacaacaattttcaggcaaatacgcaac

SEQ ID NO: 721 - DNA, 200 bp, Amaranthus rudis
gcatagttgctgttgagacacagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcccacttttcattttagctaattggagaggtttctcg

SEQ ID NO: 722 - DNA, 200 bp, Amaranthus rudis
cgagaaacctctccaattagctaaaatgaaaagtgggagttcttcccggttgaaatccatcagcgcttgtgctgtcttggatgcggaatctgggaaccatacttgccctgcttgtggtacgactctctcatgtgagtcgagttgaccgggatctgctgggattacttgcataacagtctgtgtctcaacagcaactatgc

SEQ ID NO: 723 - DNA, 200 bp, Amaranthus rudis
tttagctaattggagaggtttctcgggtggacaaagggatctctttgaagggatccttcaggctggatccaccatagtcgaaaatcttaggacttataatcaacccgtttttgtttatatacctatgatgggggagcttcgaggagggcatgggtggtcgtcgatagtcgaattaattccgaccatatagaaatgtacgc

SEQ ID NO: 724 - DNA, 200 bp, Amaranthus rudis
gcgtacatttctatatggtcggaattaattcgactatcgacgaccacccatgccctcctcgaagctcccccatcataggtatataaacaaaaacgggttgattataagtcctaagattttcgactatggtggatccagcctgaaggatcccttcaaagagatccctttgtccacccgagaaacctctccaattagctaaa

SEQ ID NO: 725 - DNA, 200 bp, Amaranthus rudis
attccgaccatatagaaatgtacgccgaccaaacagctaaaggaaatgtacttgaacccgaaggaatgatcgagattaagttcagaaccaaggaacttctcgagtgtatgggaaggcttgatcaacaactcatcggtctcaaagaaaaactagccgaagccaagagctctaattcctatggtaaaatcgacccgcttcag

SEQ ID NO: 726 - DNA, 200 bp, Amaranthus rudis
ctgaagcgggtcgattttaccataggaattagagctcttggcttcggctagtttttctttgagaccgatgagttgttgatcaagccttcccatacactcgagaagttccttggttctgaacttaatctcgatcattccttcgggttcaagtacatttcctttagctgtttggtcggcgtacatttctatatggtcggaat

SEQ ID NO: 727 - DNA, 200 bp, Amaranthus rudis
ctatggtaaaatcgacccgcttcagcaacaaataaaagcccgcgagaagcaactattgcctctatatactcagatagccaccaaatttgccgagttgcacgatacgtctttaaggatggctgccaaaggagtcattagggacgtcttggaatggaaaagctcgcgttctttcttttacaaacgattatacaggagagtga

SEQ ID NO: 728 - DNA, 200 bp, Amaranthus rudis
tcactctcctgtataatcgtttgtaaaagaaagaacgcgagcttttccattccaagacgtccctaatgactcctttggcagccatccttaaagacgtatcgtgcaactcggcaaatttggtggctatctgagtatatagaggcaatagttgcttctcgcgggcttttatttgttgctgaagcgggtcgattttaccatag

SEQ ID NO: 729 - DNA, 200 bp, Amaranthus rudis
tacaaacgattatacaggagagtgatggaagaatcgctcgtcaagaccgttcgagatgctgcaggtgaacggttgacccataagtcggctttggagttgatccggaaatggttcaatgagtcgatatttccggagaggcttccgatgcttgggctgatgatgcagccttctttaagtggaaggataataccgctaactac

SEQ ID NO: 730 - DNA, 200 bp, Amaranthus rudis
gtagttagcggtattatccttccacttaaagaaggctgcatcatcagcccaagcatcggaagcctctccggaaatatcgactcattgaaccatttccggatcaactccaaagccgacttatgggtcaaccgttcacctgcagcatctcgaacggtcttgacgagcgattcttccatcactctcctgtataatcgtttgta

SEQ ID NO: 731 - DNA, 200 bp, Amaranthus rudis
gtggaaggataataccgctaactacgaggagaagttgaaagagttgcgcgttcagaaggtattggatcagctgtcgaatattggagattcggtaactaatttgagggctctgcctcagggtcttgctgccctacttcaaaaggtggatccatcgagtcgagaagaactagttgaggaactccgaaaagtgctcacttgat

SEQ ID NO: 732 - DNA, 200 bp, Amaranthus rudis
atcaagtgagcacttttcggagttcctcaactagttcttctcgactcgatggatccaccttttgaagtagggcagcaagaccctgaggcagagccctcaaattagttaccgaatctccaatattcgacagctgatccaataccttctgaacgcgcaactctttcaacttctcctcgtagttagcggtattatccttccac

SEQ ID NO: 733 - DNA, 200 bp, Amaranthus rudis
gaactccgaaaagtgctcacttgattagcggccgttgatggtgaagtgaaaccttcttggtttcatcatggtagaaattattattaggcaaatctataattctagttacatcaattgtattagacaatagtatgaactaatttatttaattaaattgtataaataggaaaccttgaattcatttgaattaatcggcttat

SEQ ID NO: 734 - DNA, 200 bp, Amaranthus rudis
ataagccgattaattcaaatgaattcaaggtttcctatttatacaatttaattaaataaattagttcatactattgtctaatacaattgatgtaactagaattatagatttgcctaataataatttctaccatgatgaaaccaagaaggtttcacttcaccatcaacggccgctaatcaagtgagcacttttcggagttc

SEQ ID NO: 735 - DNA, 200 bp, Amaranthus rudis
agatgctttctttcttgcagttacaaatcttgcttgtgcaaagaaacttcctcttatttatctggctgcaaattcaggagctcgacttggtgttgccgaagagctaaaatcctgctttaaagttggctggtcggatgagtcaaaccccgagagtggatttcagtatgtctacttaaccccggaagattacgatcgtatcg

SEQ ID NO: 736 - DNA, 200 bp, Amaranthus rudis
cgatacgatcgtaatcttccggggttaagtagacatactgaaatccactctcggggtttgactcatccgaccagccaactttaaagcaggattttagctcttcggcaacaccaagtcgagctcctgaatttgcagccagataaataagaggaagtttctttgcacaagcaagatttgtaactgcaagaaagaaagcatct

SEQ ID NO: 737 - DNA, 200 bp, Amaranthus rudis
accccggaagattacgatcgtatcggatcgtcagtcatagcccacgagttaaaactcgaaagtggagaaaaaagatgggttatagacacagttgtcggtaaggaggacggattaggtgtcgagaatttatcaggaagtggtgctatagcaagtgcatactcaagggcttacaaggaaacatttactctgacttttgtaac

SEQ ID NO: 738 - DNA, 200 bp, Amaranthus rudis
gttacaaaagtcagagtaaatgtttccttgtaagcccttgagtatgcacttgctatagcaccacttcctgataaattctcgacacctaatccgtcctccttaccgacaactgtgtctataacccatcttttttctccactttcgagttttaactcgtgggctatgactgacgatccgatacgatcgtaatcttccggggt

SEQ ID NO: 739 - DNA, 200 bp, Amaranthus rudis
cataccaatgtccgagcatcaaaaatcggacacgggtacgtgaagcaaaataaagagtccgagtaacatacttatgattaatgttaaataacttattgtctttattgtctatatccagaaagcatcgactagtagtgcagcgactgtttcagagtatataggctatcttgaaaaaggtcaaattcctccgaaggtatgca

SEQ ID NO: 740 - DNA, 200 bp, Amaranthus rudis
tgcataccttcggaggaatttgacctttttcaagatagcctatatactctgaaacagtcgctgcactactagtcgatgctttctggatatagacaataaagacaataagttatttaacattaatcataagtatgttactcggactctttattttgcttcacgtacccgtgtccgatttttgatgctcggacattggtatg

SEQ ID NO: 741 - DNA, 200 bp, Amaranthus rudis
ggtcaaattcctccgaaggtatgcaacataccagtggttggcgggtgtttagattaacttattctatttatatcaattatactttcagtgttctgctttaattctggttttatgattgcagcatatatcactcgtccactatgaagttgctctaaatattgaggggatgaaatatactgtatgttccatgccactcgtac

SEQ ID NO: 742 - DNA, 200 bp, Amaranthus rudis
gtacgagtggcatggaacatacagtatatttcatcccctcaatatttagagcaacttcatagtggacgagtgatatatgctgcaatcataaaaccagaattaaagcagaacactgaaagtataattgatataaatagaataagttaatctaaacacccgccaaccactggtatgttgcataccttcggaggaatttgacc

SEQ ID NO: 743 - DNA, 200 bp, Amaranthus rudis
actgtatgttccatgccactcgtactttcctcgtgaatttttgtaatggatgctatttttgacattattctttctaaatatgttttcctgatattaatgaacatgtggtttcggattgccagattgagatgattaggggtggaccaggaagctacaaaatgtggttgaatgggtccgtaattgaggcggaaatacatact

SEQ ID NO: 744 - DNA, 200 bp, Amaranthus rudis
agtatgtatttccgcctcaattacggacccattcaaccacattttgtagcttcctggtccacccctaatcatctcaatctggcaatccgaaaccacatgttcattaatatcaggaaaacatatttagaaagaataatgtcaaaaatagcatccattacaaaaattcacgaggaaagtacgagtggcatggaacatacagt

SEQ ID NO: 745 - DNA, 200 bp, Amaranthus rudis
cgtaattgaggcggaaatacatactttaagagatgggggtctcttgatgcaggtataacctgtttttttggattttttccgatatacggtatttttattttatatggaccctggatttgaaaagcattagataatgtgctatcgaacaagtagaaggtagttttgtgagaccgtgaagcatttagttaaacccattgtta

SEQ ID NO: 746 - DNA, 200 bp, Amaranthus rudis
taacaatgggtttaactaaatgcttcacggtctcacaaaactaccttctacttgttcgatagcacattatctaatgcttttcaaatccagggtccatataaaataaaaataccgtatatcggaaaaaatccaaaaaaacaggttatacctgcatcaagagacccccatctcttaaagtatgtatttccgcctcaattacg

SEQ ID NO: 747 - DNA, 200 bp, Amaranthus rudis
aagcatttagttaaacccattgttaagattaccttttagatttagtacttctacaatgcttgggatattaatcaataatcatgcttttaataataaagagaaatattgtcatagactcataggtataatggctcgttaaattatatgcacttcttgtttatgtgaagttcgagatgctgtttgtaatcaactttggaaat

SEQ ID NO: 748 - DNA, 200 bp, Amaranthus rudis
atttccaaagttgattacaaacagcatctcgaacttcacataaacaagaagtgcatataatttaacgagccattatacctatgagtctatgacaatatttctctttattattaaaagcatgattattgattaatatcccaagcattgtagaagtactaaatctaaaaggtaatcttaacaatgggtttaactaaatgctt

SEQ ID NO: 749 - DNA, 200 bp, Amaranthus rudis
gctgtttgtaatcaactttggaaatcgagggcatagtgcaaaatctcggatgtggtcacctttgatgcaacaatctcaaagccacttttgtggtcaatgtagatggtttcatttttatcgtggtataaatatgggtcgcggtaatctcaagaacccatatagtagacgataacttgttattaaaagggataaggctgcat

SEQ ID NO: 750 - DNA, 200 bp, Amaranthus rudis
atgcagccttatcccttttaataacaagttatcgtctactatatgggttcttgagattaccgcgacccatatttataccacgataaaaatgaaaccatctacattgaccacaaaagtggctttgagattgttgcatcaaaggtgaccacatccgagattttgcactatgccctcgatttccaaagttgattacaaacagc

SEQ ID NO: 751 - DNA, 200 bp, Amaranthus rudis
cggttgcgtatttgccggaaaattcttgtgatcctcgtggtgctatatctggtacggttgactccaccggtaaatggtttgggggtatcttcgacaaagatagttttgtggaaaccttagaaggctgggcacgaacagttgtcacgggaagggctaaacttggaggaattccagttggcatagttgccgttgagacgcag

SEQ ID NO: 752 - DNA, 200 bp, Amaranthus rudis
ctgcgtctcaacggcaactatgccaactggaattcctccaagtttagcccttcccgtgacaactgttcgtgcccagccttctaaggtttccacaaaactatctttgtcgaagatacccccaaaccatttaccggtggagtcaaccgtaccagatatagcaccacgaggatcacaagaattttccggcaaatacgcaaccg

SEQ ID NO: 753 - DNA, 200 bp, Amaranthus rudis
tggcatagttgccgttgagacgcagactgttatgcaagtaatcccagcagatcccggtcaactcgactcacacgagagagtcgtaccacaagcagggcaagtatggttcccagattccgcatccaagacagcacaagcgctgatggatttcaaccgggaagaactcccacttttcattttagctaattggagaggtttct

SEQ ID NO: 754 - DNA, 200 bp, Amaranthus rudis
agaaacctctccaattagctaaaatgaaaagtgggagttcttcccggttgaaatccatcagcgcttgtgctgtcttggatgcggaatctgggaaccatacttgccctgcttgtggtacgactctctcgtgtgagtcgagttgaccgggatctgctgggattacttgcataacagtctgcgtctcaacggcaactatgcca

SEQ ID NO: 755 - DNA, 200 bp, Amaranthus rudis
attttagctaattggagaggtttctcgggtggacaaagggatctctttgaagggatccttcaggccggatccaccattgtcgaaaatcttaggacttataatcaacccgtttttgtttatatacctatgatgggggagcttcgaggaggagcatgggtggtcgtcgatagtcgaattaattccgaccatatagaaatgta

SEQ ID NO: 756 - DNA, 200 bp, Amaranthus rudis
tacatttctatatggtcggaattaattcgactatcgacgaccacccatgctcctcctcgaagctcccccatcataggtatataaacaaaaacgggttgattataagtcctaagattttcgacaatggtggatccggcctgaaggatcccttcaaagagatccctttgtccacccgagaaacctctccaattagctaaaat

SEQ ID NO: 757 - DNA, 200 bp, Amaranthus rudis
ttaattccgaccatatagaaatgtacgccgaccaaacagctaaaggaaatgtacttgaacccgaaggaatgatcgagattaagttcagaaccaaggaacttctcgagtgtatgggaaggcttgatcaacaactcatcggtctcaaagaaaaactagccgaagccaagagctctaattcctatggtaaaatcgacccgctt

SEQ ID NO: 758 - DNA, 200 bp, Amaranthus rudis
aagcgggtcgattttaccataggaattagagctcttggcttcggctagtttttctttgagaccgatgagttgttgatcaagccttcccatacactcgagaagttccttggttctgaacttaatctcgatcattccttcgggttcaagtacatttcctttagctgtttggtcggcgtacatttctatatggtcggaattaa

SEQ ID NO: 759 - DNA, 200 bp, Amaranthus rudis
ttcctatggtaaaatcgacccgcttcagcaacaaataaaagcccgcgagaagcaactattgcctctatatactcagatagccaccaaatttgccgagttgcacgatacgtctttaaggatggctgccaaaggagtcattagggacgtcttggaatggaaaagctcgcgttctttcttttacaaacgattatacaggagag

SEQ ID NO: 760 - DNA, 200 bp, Amaranthus rudis
ctctcctgtataatcgtttgtaaaagaaagaacgcgagcttttccattccaagacgtccctaatgactcctttggcagccatccttaaagacgtatcgtgcaactcggcaaatttggtggctatctgagtatatagaggcaatagttgcttctcgcgggcttttatttgttgctgaagcgggtcgattttaccataggaa

SEQ ID NO: 761 - DNA, 200 bp, Amaranthus rudis
ttttacaaacgattatacaggagagtgatggaagaatcgctcgtcaagaccgttcgagatgctgcaggtgaacggttgacccataagtcggctttggagttgatccggaaatggttcaatgagtccgatatttccggagaggcttctgatgcttgggctgatgatgcagccttctttaaatggaaggataataccgctaa

SEQ ID NO: 762 - DNA, 200 bp, Amaranthus rudis
ttagcggtattatccttccatttaaagaaggctgcatcatcagcccaagcatcagaagcctctccggaaatatcggactcattgaaccatttccggatcaactccaaagccgacttatgggtcaaccgttcacctgcagcatctcgaacggtcttgacgagcgattcttccatcactctcctgtataatcgtttgtaaaa

SEQ ID NO: 763 - DNA, 200 bp, Amaranthus rudis
ttaaatggaaggataataccgctaactacgaggagaagttgaaagagttgcgcgttcagaaggtattggatcagctgtcgaatattggagattcggtaactaatttgagggctctgcctcagggtcttgctgccctacttcaaaaggtggatccatcgagtcgagaagaactagttgaggaactccgaaaagtgctcact

SEQ ID NO: 764 - DNA, 200 bp, Amaranthus rudis
agtgagcacttttcggagttcctcaactagttcttctcgactcgatggatccaccttttgaagtagggcagcaagaccctgaggcagagccctcaaattagttaccgaatctccaatattcgacagctgatccaataccttctgaacgcgcaactctttcaacttctcctcgtagttagcggtattatccttccatttaa

SEQ ID NO: 765 - DNA, 200 bp, Amaranthus rudis
tgaggaactccgaaaagtgctcacttgattagcggccgttgatggtgaagtgaaaccttcttggtttcatcatggtagaaattattattaggcaaatctataattctagttacatcaattgtattagacaatagtatgaactaatttatttaattaaattgtataaataggaaaccttgaattcatttgaattaatcggc

SEQ ID NO: 766 - DNA, 200 bp, Amaranthus rudis
gccgattaattcaaatgaattcaaggtttcctatttatacaatttaattaaataaattagttcatactattgtctaatacaattgatgtaactagaattatagatttgcctaataataatttctaccatgatgaaaccaagaaggtttcacttcaccatcaacggccgctaatcaagtgagcacttttcggagttcctca

SEQ ID NO: 767 - DNA, 200 bp, Amaranthus rudis
ggggccatggtcgttattaaaactcttcagttcttgccatcggtgattgcctgcagcattgagagaaacaactcatggttcagatcaatcaacttccactggctctatagaaccagtcatccatggaaatatgttgcacattgcactagtcggggtgaataaccagatgagcttgttgcaggatagtggtgatgaagatc

SEQ ID NO: 768 - DNA, 200 bp, Amaranthus rudis
gatcttcatcaccactatcctgcaacaagctcatctggttattcaccccgactagtgcaatgtgcaacatatttccatggatgactggttctatagagccagtggaagttgattgatctgaaccatgagttgtttctctcaatgctgcaggcaatcaccgatggcaagaactgaagagttttaataacgaccatggcccc

SEQ ID NO: 769 - DNA, 200 bp, Amaranthus rudis
ttgcaggatagtggtgatgaagatcaggctcaagagagaatcgataagttggccaaaattctgagagaacaagaagtaagttcagcccttcgtgctgttggtgttggtgtgattagttgcatcatacagagagatgaagggcgaactccgatgaggcattcattctattggtcagcagaaaaacaatattatagtgagga

SEQ ID NO: 770 - DNA, 200 bp, Amaranthus rudis
tcctcactataatattgtttttctgctgaccaatagaatgaatgcctcatcggagttcgcccttcatctctctgtatgatgcaactaatcacaccaacaccaacagcacgaagggctgaacttacttcttgttctctcagaattttggccaacttatcgattctctcttgagcctgatcttcatcaccactatcctgcaa

SEQ ID NO: 771 - DNA, 200 bp, Amaranthus rudis
cagaaaaacaatattatagtgaggagcctttactacgtcatttggaaccccctctgtctatgtatctcgagctggacaagcttaagggttatgaagatatcaaatatactccttcccgtgatcgtcaatggcatctttacacggttattgataaaccattcattcggaggatgtttttgagaacccttgtaagacaaccc

SEQ ID NO: 772 - DNA, 200 bp, Amaranthus rudis
gggttgtcttacaagggttctcaaaaacatcctccgaatgaatggtttatcaataaccgtgtaaagatgccattgacgatcacgggaaggagtatatttgatatcttcataacccttaagcttgtccagctcgagatacatagacagagggggttccaaatgacgtagtaaaggctcctcactataatattgtttttctg

SEQ ID NO: 773 - DNA, 200 bp, Amaranthus rudis
tttgagaacccttgtaagacaacccatctccgagttcacaggcgtcgaactaagcgctcttgaaacacaaaagcctatctcttttacttcaagaagcatcctaaggtccttaacaaccgccatggaggagttggaactcaatgcacatagtgcttcactgaaacccgatcacgctcatatgtacttgtacattgtccgag

SEQ ID NO: 774 - DNA, 200 bp, Amaranthus rudis
ctcggacaatgtacaagtacatatgagcgtgatcgggtttcagtgaagcactatgtgcattgagttccaactcctccatggcggttgttaaggaccttaggatgcttcttgaagtaaaagagataggcttttgtgtttcaagagcgcttagttcgacgcctgtgaactcggagatgggttgtcttacaagggttctcaaa

SEQ ID NO: 775 - DNA, 200 bp, Amaranthus rudis
catatgtacttgtacattgtccgagagcaacaaatatacgatcttgtgccatatcacagggaggtgaacatagattaccaacaagaagagacttcggttcaattctttttggaagatctcgcgcatgaaatccacagtcttgctggtgtaaggatgcataaactaaatgtttgtgagtgggaagtgaaacttcggatatc

SEQ ID NO: 776 - DNA, 200 bp, Amaranthus rudis
gatatccgaagtttcacttcccactcacaaacatttagtttatgcatccttacaccagcaagactgtggatttcatgcgcgagatcttccaaaaagaattgaaccgaagtctcttcttgttggtaatctatgttcacctccctgtgatatggcacaagatcgtatatttgttgctctcggacaatgtacaagtacatatg

SEQ ID NO: 777 - DNA, 200 bp, Amaranthus rudis
agtgggaagtgaaacttcggatatcatctcccgggaaagctaatggtttatggagggtggcggttacaaatgtgactggtcagacctgttcggtacatgtttaccgtgaattggaagataacaacctacatgaaatggtctaccattcagtatccgttcacggcccccaccatggggtacctgtgaatgcaccctatcaa

SEQ ID NO: 778 - DNA, 200 bp, Amaranthus rudis
ttgatagggtgcattcacaggtaccccatggtgggggccgtgaacggatactgaatggtagaccatttcatgtaggttgttatcttccaattcacggtaaacatgtaccgaacaggtctgaccagtcacatttgtaaccgccaccctccataaaccattagctttcccgggagatgatatccgaagtttcacttcccact

SEQ ID NO: 779 - DNA, 200 bp, Amaranthus rudis
tcagccttatcttgtcaagggaagtgtcaggatgctgtggcacagatcaggcttcatagctttatgggaatttgtggaggagaatattgaccgaacaaatttttctgatgatctgactacaaacagtgagcgaaagtggggggccatggtcgttattaaaactcttcagttcttgccatcggtgattgctgcagcattga

SEQ ID NO: 780 - DNA, 200 bp, Amaranthus rudis
tcaatgctgcagcaatcaccgatggcaagaactgaagagttttaataacgaccatggccccccactttcgctcactgtttgtagtcagatcatcagaaaaatttgttcggtcaatattctcctccacaaattcccataaagctatgaagcctgatctgtgccacagcatcctgacacttcccttgacaagataaggctga

SEQ ID NO: 781 - DNA, 200 bp, Amaranthus rudis
ccatcggtgattgctgcagcattgagagaaacaactcatggttcagatcaatcaacttccactggctctatagaaccagtcatccatggaaatatgttgcacattgcactagtcggggtgaataaccagatgagcttgttgcaggataggtacgtaagactagcctgtaacatatggtttaatagttttattatgtaacc

SEQ ID NO: 782 - DNA, 200 bp, Amaranthus rudis
ggttacataataaaactattaaaccatatgttacaggctagtcttacgtacctatcctgcaacaagctcatctggttattcaccccgactagtgcaatgtgcaacatatttccatggatgactggttctatagagccagtggaagttgattgatctgaaccatgagttgtttctctcaatgctgcagcaatcaccgatgg

SEQ ID NO: 783 - DNA, 200 bp, Amaranthus rudis
ggtttaatagttttattatgtaaccttgtgcttttaatgtcatttatttctagccgatattacgtaagactagccgatattcatccgatcttgtaactgaacccgacttcaaaatcaaatttaaattatatataaatcaacgtggacataagacccgattttaatctgacccgaaatcaacccaatgacccgaatgaaca

SEQ ID NO: 784 - DNA, 200 bp, Amaranthus rudis
tgttcattcgggtcattgggttgatttcgggtcagattaaaatcgggtcttatgtccacgttgatttatatataatttaaatttgattttgaagtcgggttcagttacaagatcggatgaatatcggctagtcttacgtaatatcggctagaaataaatgacattaaaagcacaaggttacataataaaactattaaacc

SEQ ID NO: 785 - DNA, 200 bp, Amaranthus rudis
atcaacccaatgacccgaatgaacacctatagttatcactaacaagggtcaggttacgtacatcaaacccctcaaatcctgcttaggtgggagcttgtcattggcattggggtaacgggaatgtgtgtgctatgtacattgtgcatctattcttatacttatgttgtgagttttttggatcgaatataaagagcttatct

SEQ ID NO: 786 - DNA, 200 bp, Amaranthus rudis
agataagctctttatattcgatccaaaaaactcacaacataagtataagaatagatgcacaatgtacatagcacacacattcccgttaccccaatgccaatgacaagctcccacctaagcaggatttgaggggtttgatgtacgtaacctgacccttgttagtgataactataggtgttcattcgggtcattgggttgat

SEQ ID NO: 787 - DNA, 200 bp, Amaranthus rudis
ttgcttgaacaaacgaaattgagtgagctccgttcgaacattgctagaaacctctctgagctagaaatgtttaccgaggatggcgaaaacatggatactccaaaaagaaaaagtgctattaatgaacgcatggaggcccttgtgagtactcctctagctgttgaagatgcccttgttggtttgtttgatcacagtgatca

SEQ ID NO: 788 - DNA, 200 bp, Amaranthus rudis
tgatcactgtgatcaaacaaaccaacaagggcatcttcaacagctagaggagtactcacaagggcctccatgcgttcattaatagcactttttctttttggagtatccatgttttcgccatcctcggtaaacatttctagctcagagaggtttctagcaatgttcgaacggagctcactcaatttcgtttgttcaagcaa

SEQ ID NO: 789 - DNA, 200 bp, Amaranthus rudis
ttttaagaacgtaatttctttttatttatgagaagttgcagatgatgtttgttataaatggtcaatcgaaaaactacctctttgttatcagtaacaagggtaaggttgtatatatccgactcctccaaactcttcttcggtgggagctacttaatgtcgctggggcaatggaagttgttgtttgtcgaatttaagtggag

SEQ ID NO: 790 - DNA, 200 bp, Amaranthus rudis
ctccacttaaattcgacaaacaacaacttccattgccccagcgacattaagtagctcccaccgaagaagagtttggaggagtcggatatatacaaccttacccttgttactgataacaaagaggtagtttttcgattgaccatttataacaaacatcatctgcaacttctcataaataaaaagaaattacgttcttaaaa

SEQ ID NO: 791 - DNA, 200 bp, Amaranthus rudis
tgttgtttgtcgaatttaagtggagaagtttgtttacattgaattttaattagatggtataagtatgttatcaaagatttataattgaaaactggtgtgataaacagtttcaggagcagtggtctcattttcgagcaatacaaaaagtgccgtgcttctctaaacaacgacgattcagacatggcttctcattcccaaaa

SEQ ID NO: 792 - DNA, 200 bp, Amaranthus rudis
ttttgggaatgagaagccatgtctgaatcgtcgttgtttagagaagcacggcactttttgtattgctcgaaaatgagaccactgctcctgaaactgtttatcacaccagttttcaattataaatctttgataacatacttataccatctaattaaaattcaatgtaaacaaacttctccacttaaattcgacaaacaaca

SEQ ID NO: 793 - DNA, 200 bp, Amaranthus rudis
cagacatggcttctcattcccaaaatagtgaatacctgaatggaccgatgatgccactcctgaggaattcatctgtattacccattgtggataagttctgttatgctcttggagggacgcggccaatccatagtattttgatagcaaacaatgggatggctgctgtcaaatttataagaagtatccgaacatgggcttac

SEQ ID NO: 794 - DNA, 200 bp, Amaranthus rudis
gtaagcccatgttcggatacttcttataaatttgacagcagccatcccattgtttgctatcaaaatactatggattggccgcgtccctccaagagcataacagaacttatccacaatgggtaatacagatgaattcctcaggagtggcatcatcggtccattcaggtattcactattttgggaatgagaagccatgtctg

SEQ ID NO: 795 - DNA, 200 bp, Amaranthus rudis
aagaagtatccgaacatgggcttacgagacttttggtacagagaaggctatattattggtagccatggctactcccgaagacatgaaaatcaatgccgagcatattcgaatggctgaccagtttgttgaagtccccggagggactaacaacaataactatgccaatgtgcagctcattgttgaggtaatgtattgtgaga

SEQ ID NO: 796 - DNA, 200 bp, Amaranthus rudis
tctcacaatacattacctcaacaatgagctgcacattggcatagttattgttgttagtccctccggggacttcaacaaactggtcagccattcgaatatgctcggcattgattttcatgtcttcgggagtagccatggctaccaataatatagccttctctgtaccaaaagtctcgtaagcccatgttcggatacttctt

SEQ ID NO: 797 - DNA, 200 bp, Amaranthus rudis
attgttgaggtaatgtattgtgagattagaaatttctagcctattatccatagttacatggaacgtggaacgtagccacgttccgtgatccgggaacattcattccccaatcaccacgaaatgcgacctaaatcgctcaaggtgacgtctcggtgtagaacaccttttttaaaatgtattttggccttcatttacaaatt

SEQ ID NO: 798 - DNA, 200 bp, Amaranthus rudis
aatttgtaaatgaaggccaaaatacattttaaaaaaggtgttctacaccgagacgtcaccttgagcgatttaggtcgcatttcgtggtgattggggaatgaatgttcccggatcacggaacgtggctacgttccacgttccatgtaactatggataataggctagaaatttctaatctcacaatacattacctcaacaat

SEQ ID NO: 799 - DNA, 200 bp, Amaranthus rudis
gtattttggccttcatttacaaattaaagaaaaaagaaaggaggaacaaacgagatgtaacccagaaacctaaaaaagatccacttgaaaataatttcttaaagcaaattaatcattttagtttaattttttttcaaatatatattttatacgtaatgtatctcgtacccaatcgaacctgtcgttccaggtaacaatgc

SEQ ID NO: 800 - DNA, 200 bp, Amaranthus rudis
gcattgttacctggaacgacaggttcgattgggtacgagatacattacgtataaaatatatatttgaaaaaaaattaaactaaaatgattaatttgctttaagaaattattttcaagtggatcttttttaggtttctgggttacatctcgtttgttcctcctttcttttttctttaatttgtaaatgaaggccaaaatac

SEQ ID NO: 801 - DNA, 200 bp, Amaranthus rudis
aacctgtcgttccaggtaacaatgctgttatctgctttattgtaatttattaaatgtgtcctctgaaaaaatggcaatatccgagcaacttgacgcagttttgcctggccagagacatgcgtaatttgttatatgagattacaaatttatagccttttatatggtaaaatcttgtggtaggactaacttaaatccttttt

SEQ ID NO: 802 - DNA, 200 bp, Amaranthus rudis
aaaaaggatttaagttagtcctaccacaagattttaccatataaaaggctataaatttgtaatctcatataacaaattacgcatgtctctggccaggcaaaactgcgtcaagttgctcggatattgccattttttcagaggacacatttaataaattacaataaagcagataacagcattgttacctggaacgacaggtt

SEQ ID NO: 803 - DNA, 200 bp, Amaranthus rudis
ggtaggactaacttaaatcctttttctttcagttagcggaagttacacgagttgacgcagtttggcctggttggggacatgcgtcagagatccccgagctgccagattcactaagtgcgaagggaattgtgtttctagggcccccagctgcatctatggctgctcttggagataaaattggttcatcattgattgcacaa

SEQ ID NO: 804 - DNA, 200 bp, Amaranthus rudis
ttgtgcaatcaatgatgaaccaattttatctccaagagcagccatagatgcagctgggggccctagaaacacaattcccttcgcacttagtgaatctggcagctcggggatctctgacgcatgtccccaaccaggccaaactgcgtcaactcgtgtaacttccgctaactgaaagaaaaaggatttaagttagtcctacc

SEQ ID NO: 805 - DNA, 200 bp, Amaranthus spinosus
aagaacggtcggtattggtgcctatcttgctcgtcttgggatgcgttgtatacagaggcttgaccagcctataattctcacgggtttttctgccttaaataaacttctcggccgggaggtttatagttcacacatgcaacttggtggaccgaagattatgggcacaaacggggtagttcatcttacagtttccgatgatc

SEQ ID NO: 806 - DNA, 200 bp, Amaranthus spinosus
gatcatcggaaactgtaagatgaactaccccgtttgtgcccataatcttcggtccaccaagttgcatgtgtgaactataaacctcccggccgagaagtttatttaaggcagaaaaacccgtgagaattataggctggtcaagcctctgtatacaacgcatcccaagacgagcaagataggcaccaataccgaccgttctt

SEQ ID NO: 807 - DNA, 200 bp, Amaranthus spinosus
gttcatcttacagtttccgatgatcttgaaggcatttcatctatcttgaagtggctgagctacgttccaccctattcaggtggtgaacttccgatttctcggtgtttagaccctccagaaagaccggttgcgtatttgcctgaaaattcttgtgatcctcgtggtgctatatctggtacggttgactccaccggtaaatg

SEQ ID NO: 808 - DNA, 200 bp, Amaranthus spinosus
catttaccggtggagtcaaccgtaccagatatagcaccacgaggatcacaagaattttcaggcaaatacgcaaccggtctttctggagggtctaaacaccgagaaatcggaagttcaccacctgaatagggtggaacgtagctcagccacttcaagatagatgaaatgccttcaagatcatcggaaactgtaagatgaac

SEQ ID NO: 809 - DNA, 200 bp, Amaranthus spinosus
gtacggttgactccaccggtaaatggtttgggggtattttcgacaaagatagttttgtggaaaccttagaaggatgggcacgaacagttgtcacgggaagggctaaactcggaggaattccagttggcatagttgccgttgagacgcagactgttatgcaagtaatcccagcagatcccggtcaactcgactcacacgag

SEQ ID NO: 810 - DNA, 200 bp, Amaranthus spinosus
ctcgtgtgagtcgagttgaccgggatctgctgggattacttgcataacagtctgcgtctcaacggcaactatgccaactggaattcctccgagtttagcccttcccgtgacaactgttcgtgcccatccttctaaggtttccacaaaactatctttgtcgaaaatacccccaaaccatttaccggtggagtcaaccgtac

SEQ ID NO: 811 - DNA, 200 bp, Amaranthus spinosus
gaggtgaacatagatcaccaacaagaagaggcttcagttcaattctttttggaagatctcgcgcatgaaatccatagtcttgctggtgtaaggatgcataaactaaatgtttgtgagtgggaagtgaaacttcgggtatcatctcccgggaaagctaatggtttatggagggtggcagttactaatgtgactggtcatac

SEQ ID NO: 812 - DNA, 200 bp, Amaranthus spinosus
gtatgaccagtcacattagtaactgccaccctccataaaccattagctttcccgggagatgatacccgaagtttcacttcccactcacaaacatttagtttatgcatccttacaccagcaagactatggatttcatgcgcgagatcttccaaaaagaattgaactgaagcctcttcttgttggtgatctatgttcacctc

SEQ ID NO: 813 - DNA, 200 bp, Amaranthus spinosus
cagttactaatgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatcgcccgtaagcgacttcaggccatgaaaagtagcacaacttactgt

SEQ ID NO: 814 - DNA, 200 bp, Amaranthus spinosus
acagtaagttgtgctacttttcatggcctgaagtcgcttacgggcgatgccaccgagtggttgatagggtgcattcacaggtaccccatggtgggggccgtgaacagatactgaatggtagaccatttcatgtaggttgctatcttccaattcacgataaacatgtaccgaacaggtatgaccagtcacattagtaactg

SEQ ID NO: 815 - DNA, 200 bp, Amaranthus spinosus
catgaaaagtagcacaacttactgttacgattttccactggctttctcaactgccctgaagcaatcatgggcatcggaagctccggatgtcaagaaaccctcggacaaagcgcttttgaaagtaaccgagcttgcatttgcggatccaaaaggcacatggggaactccgcttgttccaataaatcgcaagcctggtatga

SEQ ID NO: 816 - DNA, 200 bp, Amaranthus spinosus
tcataccaggcttgcgatttattggaacaagcggagttccccatgtgccttttggatccgcaaatgcaagctcggttactttcaaaagcgctttgtccgagggtttcttgacatccggagcttccgatgcccatgattgcttcagggcagttgagaaagccagtggaaaatcgtaacagtaagttgtgctacttttcatg

SEQ ID NO: 817 - DNA, 200 bp, Amaranthus spinosus
ttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgatcaacaactcatcggtctcaaggaaaaactagccgaagcc

SEQ ID NO: 818 - DNA, 200 bp, Amaranthus spinosus
ggcttcggctagtttttccttgagaccgatgagttgttgatcaagccttcccatacactcgagaagttccttggttcggaacttaatctcgatcattccttccggttcaagcacatttcctttagctgtttggtcggcgtacatttctatatggtcggaattaattcgactatcgacgaccacccatgcgcctcctcgaa

SEQ ID NO: 819 - DNA, 200 bp, Amaranthus spinosus
tctcaaggaaaaactagccgaagccaagagctctaattcctacaataaaattgagcccctgcagcaacaaataaaagcccgtgagaagcaactattgcctctatatactcaaatagccaccaaatttgccgagttgcacgatacgtctttaaggatggctgccaaaggagtcattagggacgtcttggaatggaaaagct

SEQ ID NO: 820 - DNA, 200 bp, Amaranthus spinosus
agcttttccattccaagacgtccctaatgactcctttggcagccatccttaaagacgtatcgtgcaactcggcaaatttggtggctatttgagtatatagaggcaatagttgcttctcacgggcttttatttgttgctgcaggggctcaattttattgtaggaattagagctcttggcttcggctagtttttccttgaga

SEQ ID NO: 821 - DNA, 200 bp, Amaranthus spinosus
agggacgtcttggaatggaaaagctcgcgttcgttcttttacaaaagattatacaggagagttatggaggaatcgctcgtcaagactgttcgagatgctgcaggtgaacggttgacccataagtcggctttggagttgatccaaaaatggttcaatgagtcgaatatttccggagaggcttccgatgcttgggctgatga

SEQ ID NO: 822 - DNA, 200 bp, Amaranthus spinosus
tcatcagcccaagcatcggaagcctctccggaaatattcgactcattgaaccatttttggatcaactccaaagccgacttatgggtcaaccgttcacctgcagcatctcgaacagtcttgacgagcgattcctccataactctcctgtataatcttttgtaaaagaacgaacgcgagcttttccattccaagacgtccct

SEQ ID NO: 823 - DNA, 200 bp, Amaranthus spinosus
aggcttccgatgcttgggctgatgatgcggccttctttaagtggaaggacaataccgccaactacgaggagaagttgaaagagttgcgcgttcagaaggtattggatcagctgtcgaatattggagattcggcaactaatttgagggctctgcctcagggtcttgctgccctacttcaaaaggtggatccatcgagtcga

SEQ ID NO: 824 - DNA, 200 bp, Amaranthus spinosus
tcgactcgatggatccaccttttgaagtagggcagcaagaccctgaggcagagccctcaaattagttgccgaatctccaatattcgacagctgatccaataccttctgaacgcgcaactctttcaacttctcctcgtagttggcggtattgtccttccacttaaagaaggccgcatcatcagcccaagcatcggaagcct

SEQ ID NO: 825 - DNA, 200 bp, Amaranthus thunbergii
gatgggttatagacaccgttgtcggtaaggaggacggattaggtgtcgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcct

SEQ ID NO: 826 - DNA, 200 bp, Amaranthus thunbergii
aggctggtcaagcctctgtatacaacgcatcccaagacgagcaagataggcaccaataccgaccgttctaccggttacaaaagtcagagtaaatgtttccttgtaagcccttgagtatgcactggctatagcaccacttcctgatagattctcgacacctaatccgtcctccttaccgacaacggtgtctataacccatc

SEQ ID NO: 827 - DNA, 200 bp, Amaranthus thunbergii
ttgtatacagaggcttgaccagcctataattctcacgggttttctgcgttaaataaacttctcggtcgggaggtttacagttcacacatgcaacttggtggaccgaagataatgggcacaaacggggtagttcatcttacagtttccgatgatcttgaaggcatttcatctatcttgaagtggctgagctatgttccaca

SEQ ID NO: 828 - DNA, 200 bp, Amaranthus thunbergii
tgtggaacatagctcagccacttcaagatagatgaaatgccttcaagatcatcggaaactgtaagatgaactaccccgtttgtgcccattatcttcggtccaccaagttgcatgtgtgaactgtaaacctcccgaccgagaagtttatttaacgcagaaaacccgtgagaattataggctggtcaagcctctgtatacaa

SEQ ID NO: 829 - DNA, 200 bp, Amaranthus thunbergii
tgaagtggctgagctatgttccacactattcaggtggtgaacttccgatttctcggtgtttagaccctcccgaaagaccggttgcgtatttgcctgaaaattgttgtgatcctcgtggggctatatctggtacggttgactccgccggtaaatggtttgggggtattttcgacaaggatagttttgtggaaaccttagaa

SEQ ID NO: 830 - DNA, 200 bp, Amaranthus thunbergii
ttctaaggtttccacaaaactatccttgtcgaaaatacccccaaaccatttaccggcggagtcaaccgtaccagatatagccccacgaggatcacaacaattttcaggcaaatacgcaaccggtctttcgggagggtctaaacaccgagaaatcggaagttcaccacctgaatagtgtggaacatagctcagccacttca

SEQ ID NO: 831 - DNA, 200 bp, Amaranthus thunbergii
ggatagttttgtggaaaccttagaaggatgggcacgaacagttgtcacgggaagggctaaactcggaggaattccagttggcatagttgctgttgagacgcagactgttatgcaagtaatcccagcagatcccggtcaactcgactcacatgagagagtcgtaccacaagcagggcaagtatggttcccagattccgcat

SEQ ID NO: 832 - DNA, 200 bp, Amaranthus thunbergii
atgcggaatctgggaaccatacttgccctgcttgtggtacgactctctcatgtgagtcgagttgaccgggatctgctgggattacttgcataacagtctgcgtctcaacagcaactatgccaactggaattcctccgagtttagcccttcccgtgacaactgttcgtgcccatccttctaaggtttccacaaaactatcc

SEQ ID NO: 833 - DNA, 200 bp, Amaranthus thunbergii
caagtatggttcccagattccgcatccaagacagcacaagcgctgatggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatat

SEQ ID NO: 834 - DNA, 200 bp, Amaranthus thunbergii
atataaacaaaaacgggttgattataagtcctaagattttcgactatggtggatccagcctgaaggatcccttcaaagagatccctttgtccacccgagaaacctctccaattagctaaaatgaaaagtgggagttcttcccggttgaaatccatcagcgcttgtgctgtcttggatgcggaatctgggaaccatacttg

SEQ ID NO: 835 - DNA, 200 bp, Amaranthus thunbergii
ataatcaacccgtttttgtttatatccctatgatgggggagcttcgaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggctt

SEQ ID NO: 836 - DNA, 200 bp, Amaranthus thunbergii
aagccttcccatacactcgagaagttccttggttcggaacttaatctcgatcattccttccggttcaagcacatttcctttagctgtttggtcggcgtacatttctatatggtcggaattaattcgactatcgacgaccacccatgcgcctcctcgaagctcccccatcatagggatataaacaaaaacgggttgattat

SEQ ID NO: 837 - DNA, 200 bp, Amaranthus thunbergii
gtgctattaatgaacgtatggaggcgcttgtgagtactcctctagctgtcgaagatgcccttgttggtttgtttgatcatagtgatcatacacttcagaggcgggttgttgagacctatgttcggaggctttatcagccttatcttgtcaagggaagtgtcaggatgctgtggcacagatcaggcttcatagctttatgg

SEQ ID NO: 838 - DNA, 200 bp, Amaranthus thunbergii
ccataaagctatgaagcctgatctgtgccacagcatcctgacacttcccttgacaagataaggctgataaagcctccgaacataggtctcaacaacccgcctctgaagtgtatgatcactatgatcaaacaaaccaacaagggcatcttcgacagctagaggagtactcacaagcgcctccatacgttcattaatagcac

SEQ ID NO: 839 - DNA, 200 bp, Amaranthus thunbergii
cagatcaggcttcatagctttatgggaatttgttgaggagaatattgaccgaacgaatttttctgatctgactacaaacagtgggaaccatagtgagcgaaagtggggggccatggtcgttattaaaactcttcagttcttgccatcggtaattgctgcagcattgagagaaacaactcatagttccgatcaatcaactt

SEQ ID NO: 840 - DNA, 200 bp, Amaranthus thunbergii
aagttgattgatcggaactatgagttgtttctctcaatgctgcagcaattaccgatggcaagaactgaagagttttaataacgaccatggccccccactttcgctcactatggttcccactgtttgtagtcagatcagaaaaattcgttcggtcaatattctcctcaacaaattcccataaagctatgaagcctgatctg

SEQ ID NO: 841 - DNA, 200 bp, Amaranthus thunbergii
actcatagttccgatcaatcaacttccactggctctatagaatcagtcatccatggaaatatgctgcacattgcactagtgggggtgaataaccagatgagcttgttgcaggatagtggtgatgaagatcaggctcaagagagaatcgataagttggccaaaattctgagagaacaagaagtgagttcagcccttcgtgc

SEQ ID NO: 842 - DNA, 200 bp, Amaranthus thunbergii
gcacgaagggctgaactcacttcttgttctctcagaattttggccaacttatcgattctctcttgagcctgatcttcatcaccactatcctgcaacaagctcatctggttattcacccccactagtgcaatgtgcagcatatttccatggatgactgattctatagagccagtggaagttgattgatcggaactatgagt

SEQ ID NO: 843 - DNA, 200 bp, Amaranthus thunbergii
aagaagtgagttcagcccttcgtgctgttggtgttggtgtgattagttgcatcatacagagagatgaagggcgaactccgatgaggcattcattctattggtcagcagaaaaacaatattatagtgaggaacctttactacgtcatttggaaccccctctatctatgtatctcgagctggacaagcttaagggttatgaa

SEQ ID NO: 844 - DNA, 200 bp, Amaranthus thunbergii
ttcataacccttaagcttgtccagctcgagatacatagatagagggggttccaaatgacgtagtaaaggttcctcactataatattgtttttctgctgaccaatagaatgaatgcctcatcggagttcgcccttcatctctctgtatgatgcaactaatcacaccaacaccaacagcacgaagggctgaactcacttctt

SEQ ID NO: 845 - DNA, 200 bp, Amaranthus thunbergii
gctggacaagcttaagggttatgaagatatcaaatatactccttcccgtgatcgtcaatggcatctttacacggttattgataaaccattcattcggaggatgtttttgagaacccttgtaagacaacccatctccgagttcactggcgtcgaactaagcgctcttgaaacacaaaagcctatctcttttacttcaagaa

SEQ ID NO: 846 - DNA, 200 bp, Amaranthus thunbergii
ttcttgaagtaaaagagataggcttttgtgtttcaagagcgcttagttcgacgccagtgaactcggagatgggttgtcttacaagggttctcaaaaacatcctccgaatgaatggtttatcaataaccgtgtaaagatgccattgacgatcacgggaaggagtatatttgatatcttcataacccttaagcttgtccagc

SEQ ID NO: 847 - DNA, 200 bp, Amaranthus thunbergii
aagcctatctcttttacttcaagaagcatcctaaggtcattaacaaccgccatggaggagttggagctcaatgcacatagtgcttcactgaaacccgatcacgctcatatgtacttgtacattgtccgagagcaacaaatatacgatcttgtgccatatcacagggaggtgaacatagattaccaacaagaagaggcttc

SEQ ID NO: 848 - DNA, 200 bp, Amaranthus thunbergii
gaagcctcttcttgttggtaatctatgttcacctccctgtgatatggcacaagatcgtatatttgttgctctcggacaatgtacaagtacatatgagcgtgatcgggtttcagtgaagcactatgtgcattgagctccaactcctccatggcggttgttaatgaccttaggatgcttcttgaagtaaaagagataggctt

SEQ ID NO: 849 - DNA, 200 bp, Amaranthus thunbergii
tagattaccaacaagaagaggcttcggttcaattctttttggaagatctcgcgcatgaaatccatagtcttgctggtgtaaggatgcataaactaaatgtttgtgagtgggaagtgaaacttcggatatcatctcccgggaaagctaatggtttatggagggtggcagttactaatgtgactggtcatacctgttcggta

SEQ ID NO: 850 - DNA, 200 bp, Amaranthus thunbergii
taccgaacaggtatgaccagtcacattagtaactgccaccctccataaaccattagctttcccgggagatgatatccgaagtttcacttcccactcacaaacatttagtttatgcatccttacaccagcaagactatggatttcatgcgcgagatcttccaaaaagaattgaaccgaagcctcttcttgttggtaatcta

SEQ ID NO: 851 - DNA, 200 bp, Amaranthus thunbergii
tgtgactggtcatacctgttcggtacatgtttatcgtgaattggaagatagcaacctacatgaaatggtctaccattcagtatctgttcacggcccccaccatggggtacctgtgaatgcaccctatcaaccactcggtggcatctcccgtaagcgacttcaggccatgaagagtagcacaacatactgttacgattttc

SEQ ID NO: 852 - DNA, 200 bp, Amaranthus thunbergii
gaaaatcgtaacagtatgttgtgctactcttcatggcctgaagtcgcttacgggagatgccaccgagtggttgatagggtgcattcacaggtaccccatggtgggggccgtgaacagatactgaatggtagaccatttcatgtaggttgctatcttccaattcacgataaacatgtaccgaacaggtatgaccagtcaca

SEQ ID NO: 853 - DNA, 200 bp, Amaranthus thunbergii
taagagatgggggtctcttgatgcagttggatggaaacagccatgtgatatatgcagaggaagaagctgcaggaactcgccttctgattgatggaagaacttgtttgcttcagaacgatcacgatccttcaaagctgattgcggagacaccgtgtaagcttatgcggtatttggtaccagataacagtcacatagatgca

SEQ ID NO: 854 - DNA, 200 bp, Amaranthus thunbergii
tgcatctatgtgactgttatctggtaccaaataccgcataagcttacacggtgtctccgcaatcagctttgaaggatcgtgatcgttctgaagcaaacaagttcttccatcaatcagaaggcgagttcctgcagcttcttcctctgcatatatcacatggctgtttccatccaactgcatcaagagacccccatctctta

SEQ ID NO: 855 - DNA, 200 bp, Amaranthus thunbergii
accagataacagtcacatagatgcagatactccgtatgctgaagttgaggtcatgaagatgtgtatgcctttgctttcccctgcatccggtgttttacaatttaagatgtccgaaggtcaagctatgcaggctggtgaactcatagctagtctagagttggatgatccttcagctgtaagaaaagccgaacctttccgtg

SEQ ID NO: 856 - DNA, 200 bp, Amaranthus thunbergii
cacggaaaggttcggcttttcttacagctgaaggatcatccaactctagactagctatgagttcaccagcctgcatagcttgaccttcggacatcttaaattgtaaaacaccggatgcaggggaaagcaaaggcatacacatcttcatgacctcaacttcagcatacggagtatctgcatctatgtgactgttatctggt

SEQ ID NO: 857 - DNA, 200 bp, Amaranthus thunbergii
gtaagaaaagccgaacctttccgtggaagctttcctgtcatgggcgcaccaactgcaatatctggaaaagttcatcagaggtgtgccgcaagtttaaatgccactcggatgattttggctggttatgaacacaatatagatgaagtagtacagagtttgctggaatgccttgatagtcccgaacttccattccttcaatg

SEQ ID NO: 858 - DNA, 200 bp, Amaranthus thunbergii
cattgaaggaatggaagttcgggactatcaaggcattccagcaaactctgtactacttcatctatattgtgttcataaccagccaaaatcatccgagtggcatttaaacttgcggcacacctctgatgaacttttccagatattgcagttggtgcgcccatgacaggaaagcttccacggaaaggttcggcttttcttac

SEQ ID NO: 859 - DNA, 200 bp, Amaranthus thunbergii
gtcccgaacttccattccttcaatggcaagaatgcttgtctgtgctggcaacacgacttcccaaagatctgagatacgaattggaatcaaaatctagagcttttgaagggattaccaacacccagaacgtagaatttcctgctaagttgttgaaaagcattcttgaggaccatttaaactcatgccacgagaaagataaa

SEQ ID NO: 860 - DNA, 200 bp, Amaranthus thunbergii
tttatctttctcgtggcatgagtttaaatggtcctcaagaatgcttttcaacaacttagcaggaaattctacgttctgggtgttggtaatcccttcaaaagctctagattttgattccaattcgtatctcagatctttgggaagtcgtgttgccagcacagacaagcattcttgccattgaaggaatggaagttcgggac

SEQ ID NO: 861 - DNA, 200 bp, Amaranthus thunbergii
aaactcatgccacgagaaagataaaggagctcaagagaggcttattgagcctcttatggctcttgcaaagtcttacgaaggtgggcgagaaagtcatgctcgttttattgttcaatctttatttgaagagtatttatccgttgaagaattgtttagcgacaatctccaggctgatgtgattgaacgtctccgccttcagt

SEQ ID NO: 862 - DNA, 200 bp, Amaranthus thunbergii
actgaaggcggagacgttcaatcacatcagcctggagattgtcgctaaacaattcttcaacggataaatactcttcaaataaagattgaacaataaaacgagcatgactttctcgcccaccttcgtaagactttgcaagagccataagaggctcaataagcctctcttgagctcctttatctttctcgtggcatgagttt

SEQ ID NO: 863 - DNA, 200 bp, Amaranthus thunbergii
gtgattgaacgtctccgccttcagtataagaaggatctgctgaagattgttgacattgtactgtcgcatcagggtgttaagaataaaaataagctgattctacgactcatggaacagctggtttacccaaatcccgctgcatacagggggaaacttatccgtttctctcaattgaaccatacaatgtattctgagttggc

SEQ ID NO: 864 - DNA, 200 bp, Amaranthus thunbergii
gccaactcagaatacattgtatggttcaattgagagaaacggataagtttccccctgtatgcagcgggatttgggtaaaccagctgttccatgagtcgtagaatcagcttatttttattcttaacaccctgatgcgacagtacaatgtcaacaatcttcagcagatccttcttatactgaaggcggagacgttcaatcac

SEQ ID NO: 865 - DNA, 200 bp, Amaranthus viridis
aggcacagtcggtgaaacctaaaggtcattgtattgctgcgcgtgtgacaagtgaggatcccgatgacggttttaagcctacaagcgggaaagtacaggagctgagttttaaaagtaaaccgaatgtgtgggcctacttctctgttaagtctgggggaggcattcatgagttctcggattctcaatttggccatgttttt

SEQ ID NO: 866 - DNA, 200 bp, Amaranthus viridis
aaaaacatggccaaattgagaatccgagaactcatgaatgcctcccccagacttaacagagaagtaggcccacacattcggtttacttttaaaactcagctcctgtactttcccgcttgtaggcttaaaaccgtcatcgggatcctcacttgtcacacgcgcagcaatacaatgacctttaggtttcaccgactgtgcct

SEQ ID NO: 867 - DNA, 200 bp, Amaranthus viridis
ggattctcaatttggccatgtttttgcatttggtgaaaaccgaggtttggccatagcaaatatgattcttggattaaaagaaattcaaattcgtggagaaattcgaactaatgttgattacaccatcgatcttttaaattgtttggattatagagaaaaccaaattcatacaggttggttggatagtagaattgcgatga

SEQ ID NO: 868 - DNA, 200 bp, Amaranthus viridis
tcatcgcaattctactatccaaccaacctgtatgaatttggttttctctataatccaaacaatttaaaagatcgatggtgtaatcaacattagttcgaatttctccacgaatttgaatttcttttaatccaagaatcatatttgctatggccaaacctcggttttcaccaaatgcaaaaacatggccaaattgagaatcc

SEQ ID NO: 869 - DNA, 200 bp, Amaranthus viridis
tggttggatagtagaattgcgatgagggtcagagccgaaaggccaccttggtacatctctgttgtgggaggagggctttacaaagcatcgactagtagtgcagcgactgtttcagagtatataggctatcttgaaaaaggtcaaattcctccgaagcatatatcactcgtccactatgaagttgctctaaatatcgaggg

SEQ ID NO: 870 - DNA, 200 bp, Amaranthus viridis
ccctcgatatttagagcaacttcatagtggacgagtgatatatgcttcggaggaatttgacctttttcaagatagcctatatactctgaaacagtcgctgcactactagtcgatgctttgtaaagccctcctcccacaacagagatgtaccaaggtggcctttcggctctgaccctcatcgcaattctactatccaacca

SEQ ID NO: 871 - DNA, 200 bp, Amaranthus viridis
atgaagttgctctaaatatcgaggggatgaaatataccattgagatgattaggggtggaccaggaagctacaaaatgtggttgaatgggtccgtagttgaggcggaaatacatactttaagagatgggggtctcttgatgcagttggatggaaacagccatgtgatatatgctgaggaagaagctgcaggaactcgcctt

SEQ ID NO: 872 - DNA, 200 bp, Amaranthus viridis
aaggcgagttcctgcagcttcttcctcagcatatatcacatggctgtttccatccaactgcatcaagagacccccatctcttaaagtatgtatttccgcctcaactacggacccattcaaccacattttgtagcttcctggtccacccctaatcatctcaatggtatatttcatcccctcgatatttagagcaacttcat

SEQ ID NO: 873 - DNA, 200 bp, Amaranthus viridis
ggaagaagctgcaggaactcgccttctgattgatggaagaacttgtttgcttcagaacgatcacgatccttcaaagctgattgcggagacaccgtgtaagcttatgcggtatttggtaccagataacagtcacatagatgcagatactccgtatgctgaagttgaggtcatgaagatgtgtatgcctttgctttcccctg

SEQ ID NO: 874 - DNA, 200 bp, Amaranthus viridis
caggggaaagcaaaggcatacacatcttcatgacctcaacttcagcatacggagtatctgcatctatgtgactgttatctggtaccaaataccgcataagcttacacggtgtctccgcaatcagctttgaaggatcgtgatcgttctgaagcaaacaagttcttccatcaatcagaaggcgagttcctgcagcttcttcc

SEQ ID NO: 875 - DNA, 200 bp, Amaranthus viridis
atgtgtatgcctttgctttcccctgcatccggtgttttacaatttaagatgtccgaaggtcaagctatgcaggctggtgagctcatagctagtctagagttggatgatccttcagctgtaagaaaagccgaacctttccgtggaagctttcctgtcatgggcgcaccaactgcaatatctggaaaagttcatcagaggtg

SEQ ID NO: 876 - DNA, 200 bp, Amaranthus viridis
cacctctgatgaacttttccagatattgcagttggtgcgcccatgacaggaaagcttccacggaaaggttcggcttttcttacagctgaaggatcatccaactctagactagctatgagctcaccagcctgcatagcttgaccttcggacatcttaaattgtaaaacaccggatgcaggggaaagcaaaggcatacacat

SEQ ID NO: 877 - DNA, 200 bp, Amaranthus viridis
tatctggaaaagttcatcagaggtgtgccgcaagtttaaatgccactcggatgattttggctggttatgaacacaatatagatgaagtagtacagagtttgctggaatgccttgatagtcccgaacttccattccttcaatggcaagaatgcttgtctgtgctggcaacacgacttcccaaagatctgagatacgaattg

SEQ ID NO: 878 - DNA, 200 bp, Amaranthus viridis
caattcgtatctcagatctttgggaagtcgtgttgccagcacagacaagcattcttgccattgaaggaatggaagttcgggactatcaaggcattccagcaaactctgtactacttcatctatattgtgttcataaccagccaaaatcatccgagtggcatttaaacttgcggcacacctctgatgaacttttccagata

SEQ ID NO: 879 - DNA, 200 bp, Amaranthus viridis
tcccaaagatctgagatacgaattggaatcaaaatctagagcttttgaagggattaccaacacccagaacgtagaatttcctgctaagttgttgaaaagcattcttgaggaccatttaaactcatgccacgagaaagataaaggagctcaagagaggcttattgagcctcttatggctcttgtaaagtcttacgaaggtg

SEQ ID NO: 880 - DNA, 200 bp, Amaranthus viridis
caccttcgtaagactttacaagagccataagaggctcaataagcctctcttgagctcctttatctttctcgtggcatgagtttaaatggtcctcaagaatgcttttcaacaacttagcaggaaattctacgttctgggtgttggtaatcccttcaaaagctctagattttgattccaattcgtatctcagatctttggga

SEQ ID NO: 881 - DNA, 200 bp, Amaranthus viridis
gctcttgtaaagtcttacgaaggtgggcgagaaagtcatgctcgttttattgttcaatctttatttgaagagtatttatccgttgaagaattgtttagcgacaatctccaggctgatgtgattgaacgtctccgtcttcagtataagaaggatctgctgaagattgttgacattgtactgtcgcatcagggtgttaagaa

SEQ ID NO: 882 - DNA, 200 bp, Amaranthus viridis
ttcttaacaccctgatgcgacagtacaatgtcaacaatcttcagcagatccttcttatactgaagacggagacgttcaatcacatcagcctggagattgtcgctaaacaattcttcaacggataaatactcttcaaataaagattgaacaataaaacgagcatgactttctcgcccaccttcgtaagactttacaagagc

SEQ ID NO: 883 - DNA, 200 bp, Amaranthus viridis
tactgtcgcatcagggtgttaagaataaaataagctgattctacgactcatggaacagctggtttacccaaatcccgctgcatacagggggcaaacttatccgtttctctcaattgaaccatacaatgtattctgagttggcactaaaggccagtcaattgcttgaacaaacgaaattgagtgagctccgttcgaacatt

SEQ ID NO: 884 - DNA, 200 bp, Amaranthus viridis
aatgttcgaacggagctcactcaatttcgtttgttcaagcaattgactggcctttagtgccaactcagaatacattgtatggttcaattgagagaaacggataagtttgccccctgtatgcagcgggatttgggtaaaccagctgttccatgagtcgtagaatcagcttattttattcttaacaccctgatgcgacagta

SEQ ID NO: 885 - DNA, 200 bp, Amaranthus viridis
attgagtgagctccgttcgaacattgctagaaacctctctgagctagaaatgtttaccgaggatggcgaaaacatggatactccaaaaagaaaaagtgctattaatgaacgtatggaggcgcttgtgagtactcctctagctgtcgaagatgcccttgttggtttgtttgatcatagtgatcatacacttcagaggcggg

SEQ ID NO: 886 - DNA, 200 bp, Amaranthus viridis
cccgcctctgaagtgtatgatcactatgatcaaacaaaccaacaagggcatcttcgacagctagaggagtactcacaagcgcctccatacgttcattaatagcactttttctttttggagtatccatgttttcgccatcctcggtaaacatttctagctcagagaggtttctagcaatgttcgaacggagctcactcaat

SEQ ID NO: 887 - DNA, 200 bp, Amaranthus viridis
agtgatcatacacttcagaggcgggttgttgagacctatgttcggaggctttatcagccttatcttgtcaagggaagtgtcaggatgctgtggcacagatcaggcttcatagctttatgggaatttgttgaggagaatattgaccgaacaaatttttctgatctgactacaaacagtgggaaccatagtgagcgaaagtg

SEQ ID NO: 888 - DNA, 200 bp, Amaranthus viridis
cactttcgctcactatggttcccactgtttgtagtcagatcagaaaaatttgttcggtcaatattctcctcaacaaattcccataaagctatgaagcctgatctgtgccacagcatcctgacacttcccttgacaagataaggctgataaagcctccgaacataggtctcaacaacccgcctctgaagtgtatgatcact

SEQ ID NO: 889 - DNA, 200 bp, Amaranthus viridis
gtgggaaccatagtgagcgaaagtggggggccatggtcgttattaaaactcttcagttcttgccatcggtaattgctgcagcattgagagaaacaactcatagttccgatcaatcaacttccactggctctatagaatcagtcatccatggaaatatgctgcacattgcactagtgggggtgaataaccagatgagcttg

SEQ ID NO: 890 - DNA, 200 bp, Amaranthus viridis
caagctcatctggttattcacccccactagtgcaatgtgcagcatatttccatggatgactgattctatagagccagtggaagttgattgatcggaactatgagttgtttctctcaatgctgcagcaattaccgatggcaagaactgaagagttttaataacgaccatggccccccactttcgctcactatggttcccac

SEQ ID NO: 891 - DNA, 200 bp, Amaranthus viridis
gggggtgaataaccagatgagcttgttgcaggatagtggtgatgaagatcaggctcaagagagaatcgataagttggccaaaattctgagagaacaagaagtgagttcagcccttcgtgctgttggtgttggtgtgattagttgcatcatacagagagatgaagggcgaactccgatgaggcattcattctattggtcag

SEQ ID NO: 892 - DNA, 200 bp, Amaranthus viridis
ctgaccaatagaatgaatgcctcatcggagttcgcccttcatctctctgtatgatgcaactaatcacaccaacaccaacagcacgaagggctgaactcacttcttgttctctcagaattttggccaacttatcgattctctcttgagcctgatcttcatcaccactatcctgcaacaagctcatctggttattcaccccc

SEQ ID NO: 893 - DNA, 200 bp, Amaranthus viridis
atgaggcattcattctattggtcagcagaaaaacaatattatagtgaggaacctttactacgtcatttggaaccccctctatctatgtatctcgagctggacaagcttaagggttatgaagatatcaaatatactccttcccgtgatcgtcaatggcatctttacacggttattgataaaccattcattcggaggatgtt

SEQ ID NO: 894 - DNA, 200 bp, Amaranthus viridis
aacatcctccgaatgaatggtttatcaataaccgtgtaaagatgccattgacgatcacgggaaggagtatatttgatatcttcataacccttaagcttgtccagctcgagatacatagatagagggggttccaaatgacgtagtaaaggttcctcactataatattgtttttctgctgaccaatagaatgaatgcctcat

SEQ ID NO: 895 - DNA, 200 bp, Amaranthus viridis
ataaaccattcattcggaggatgtttttgagaacccttgtaagacaacccatctccgagttcactggcgtcgaactaagcgctcttgaaacacaaaagcctatctcttttacttcaagaagcatcctaaggtcattaacaaccgccatggaggagttggagctcaatgcacatagtgcttcactgaaacccgatcacgct

SEQ ID NO: 896 - DNA, 200 bp, Amaranthus viridis
agcgtgatcgggtttcagtgaagcactatgtgcattgagctccaactcctccatggcggttgttaatgaccttaggatgcttcttgaagtaaaagagataggcttttgtgtttcaagagcgcttagttcgacgccagtgaactcggagatgggttgtcttacaagggttctcaaaaacatcctccgaatgaatggtttat

SEQ ID NO: 897 - DNA, 200 bp, Amaranthus viridis
tgcttcactgaaacccgatcacgctcatatgtacttgtacattgtccgagagcaacaaatatacgatcttgtgccatatcacagggaggtgaacatagattaccaacaagaagaggcttcggttcaattctttttggaagatctcgcgcatgaaatccatagtcttgctggtgtaaggatgcataaactaaatgtttgtg

SEQ ID NO: 898 - DNA, 200 bp, Amaranthus viridis
cacaaacatttagtttatgcatccttacaccagcaagactatggatttcatgcgcgagatcttccaaaaagaattgaaccgaagcctcttcttgttggtaatctatgttcacctccctgtgatatggcacaagatcgtatatttgttgctctcggacaatgtacaagtacatatgagcgtgatcgggtttcagtgaagca

SEQ ID NO: 899 - DNA, 200 bp, Amaranthus viridis
aggatgcataaactaaatgtttgtgagtgggaagtgaaacttcggatatcatctcccgggaaagctaatggtttatggagggtggcagttactaatgtgactggtcatacctgttcggtacatgtttatcgtgaattggaagatagcaacctacatgaaatggtctaccattcagtatctgttcacggcccccaccatgg

SEQ ID NO: 900 - DNA, 200 bp, Amaranthus viridis
ccatggtgggggccgtgaacagatactgaatggtagaccatttcatgtaggttgctatcttccaattcacgataaacatgtaccgaacaggtatgaccagtcacattagtaactgccaccctccataaaccattagctttcccgggagatgatatccgaagtttcacttcccactcacaaacatttagtttatgcatcct

SEQ ID NO: 901 - DNA, 200 bp, Amaranthus viridis
tatctgttcacggcccccaccatggggtacctgtgaatgcaccctatcaaccactcggtggcatctcccgtaagcgacttcaggccatgaagagtagcacaacatactgttacgattttccactggctttctcaactgccctgaagcaatcatgggcatcggaagctccggatgtcaagaaaccctcggacaaagcactt

SEQ ID NO: 902 - DNA, 200 bp, Amaranthus viridis
aagtgctttgtccgagggtttcttgacatccggagcttccgatgcccatgattgcttcagggcagttgagaaagccagtggaaaatcgtaacagtatgttgtgctactcttcatggcctgaagtcgcttacgggagatgccaccgagtggttgatagggtgcattcacaggtaccccatggtgggggccgtgaacagata

SEQ ID NO: 903 - DNA, 200 bp, Amaranthus viridis
caagaaaccctcggacaaagcacttttgaaagtaaccgagctagcatttgctgatccaaaaggcacatggggaactccgcttgttccaataaatcgcaagcctggtatgaacgatgttggcatggtagcctggtacttggaaatgtccacccccgagttccctaacggaagaacaataatggttgtagctaatgatgtta

SEQ ID NO: 904 - DNA, 200 bp, Amaranthus viridis
taacatcattagctacaaccattattgttcttccgttagggaactcgggggtggacatttccaagtaccaggctaccatgccaacatcgttcataccaggcttgcgatttattggaacaagcggagttccccatgtgccttttggatcagcaaatgctagctcggttactttcaaaagtgctttgtccgagggtttcttg

SEQ ID NO: 905 - DNA, 200 bp, Amaranthus viridis
ataatggttgtagctaatgatgttaccttcaaggccggatctttcggaccacgagaagatgctttcttccttgctgttacaaatcttgcttgcgcgaagaaacttcctcttatttatctggctgccaattcaggagctcgacttggtgttgccgaagagctaaaatcctgctttaaagttggctggtcggatgagtcaaa

SEQ ID NO: 906 - DNA, 200 bp, Amaranthus viridis
tttgactcatccgaccagccaactttaaagcaggattttagctcttcggcaacaccaagtcgagctcctgaattggcagccagataaataagaggaagtttcttcgcgcaagcaagatttgtaacagcaaggaagaaagcatcttctcgtggtccgaaagatccggccttgaaggtaacatcattagctacaaccattat

SEQ ID NO: 907 - DNA, 200 bp, Amaranthus viridis
aagttggctggtcggatgagtcaaaccccgagagtggatttcagtatgtctacttaacccctgaagattacgatcgtataggatcgtcagtcatagcccacgagttaaaactcgaaagtggagaaaaaagatgggttatagacaccgttgtcggtaaggaggacggattaggtgtcgagaatctatcaggaagtggtgct

SEQ ID NO: 908 - DNA, 200 bp, Amaranthus viridis
agcaccacttcctgatagattctcgacacctaatccgtcctccttaccgacaacggtgtctataacccatcttttttctccactttcgagttttaactcgtgggctatgactgacgatcctatacgatcgtaatcttcaggggttaagtagacatactgaaatccactctcggggtttgactcatccgaccagccaactt

SEQ ID NO: 909 - DNA, 200 bp, Amaranthus viridis
cgagaatctatcaggaagtggtgctatagccagtgcatactcaagggcttacaaggaaacatttactctgacttttgtaaccggtagaacggtcggtattggtgcctatcttgctcgtcttgggatgcgttgtatacagaggcttgaccagcctataattctcacgggtttttctgcgttaaataaacttctcggtcggg

SEQ ID NO: 910 - DNA, 200 bp, Amaranthus viridis
cccgaccgagaagtttatttaacgcagaaaaacccgtgagaattataggctggtcaagcctctgtatacaacgcatcccaagacgagcaagataggcaccaataccgaccgttctaccggttacaaaagtcagagtaaatgtttccttgtaagcccttgagtatgcactggctatagcaccacttcctgatagattctcg

SEQ ID NO: 911 - DNA, 200 bp, Amaranthus viridis
gcgttaaataaacttctcggtcgggaggtttacagttcacacatgcaacttggtggaccgaagataatgggcacaaacggggtagttcatcttacagtttccgatgatcttgaaggcatttcatctatcttgaagtggctgagctatgttccaccctattcaggtggtgaacttccgatttctcggtgtttagaccctcc

SEQ ID NO: 912 - DNA, 200 bp, Amaranthus viridis
ggagggtctaaacaccgagaaatcggaagttcaccacctgaatagggtggaacatagctcagccacttcaagatagatgaaatgccttcaagatcatcggaaactgtaagatgaactaccccgtttgtgcccattatcttcggtccaccaagttgcatgtgtgaactgtaaacctcccgaccgagaagtttatttaacgc

SEQ ID NO: 913 - DNA, 200 bp, Amaranthus viridis
cgatttctcggtgtttagaccctcccgaaagaccggttgcgtatttgcctgaaaattgttgtgatcctcgtggggctatatctggtacggttgactccgccggtaaatggtttgggggtattttcgacaaggatagttttgtggaaaccttagaaggatgggcacgaacagttgtcacgggaagggctaaactcggagga

SEQ ID NO: 914 - DNA, 200 bp, Amaranthus viridis
tcctccgagtttagcccttcccgtgacaactgttcgtgcccatccttctaaggtttccacaaaactatccttgtcgaaaatacccccaaaccatttaccggcggagtcaaccgtaccagatatagccccacgaggatcacaacaattttcaggcaaatacgcaaccggtctttcgggagggtctaaacaccgagaaatcg

SEQ ID NO: 915 - DNA, 200 bp, Amaranthus viridis
cacgggaagggctaaactcggaggaattccagttggcatagttgctgttgagacgcagactgttatgcaagtaatcccagcagatcccggtcaactcgactcacatgagagagtcgtaccacaagcagggcaagtatggttcccagattccgcatccaagacagcacaagcgctgatggatttcaaccgggaagaactcc

SEQ ID NO: 916 - DNA, 200 bp, Amaranthus viridis
ggagttcttcccggttgaaatccatcagcgcttgtgctgtcttggatgcggaatctgggaaccatacttgccctgcttgtggtacgactctctcatgtgagtcgagttgaccgggatctgctgggattacttgcataacagtctgcgtctcaacagcaactatgccaactggaattcctccgagtttagcccttcccgtg

SEQ ID NO: 917 - DNA, 200 bp, Amaranthus viridis
atggatttcaaccgggaagaactcccacttttcattttagctaattggagaggtttctcgggtggacaaagggatctctttgaagggatccttcaggctggatccaccatagtcgaaaatcttaggacttataatcaacccgtttttgtttatatccctatgatgggggagcttcgaggaggcgcatgggtggtcgtcga

SEQ ID NO: 918 - DNA, 200 bp, Amaranthus viridis
tcgacgaccacccatgcgcctcctcgaagctcccccatcatagggatataaacaaaaacgggttgattataagtcctaagattttcgactatggtggatccagcctgaaggatcccttcaaagagatccctttgtccacccgagaaacctctccaattagctaaaatgaaaagtgggagttcttcccggttgaaatccat

SEQ ID NO: 919 - DNA, 200 bp, Amaranthus viridis
gaggaggcgcatgggtggtcgtcgatagtcgaattaattccgaccatatagaaatgtacgccgaccaaacagctaaaggaaatgtgcttgaaccggaaggaatgatcgagattaagttccgaaccaaggaacttctcgagtgtatgggaaggcttgaccaacaactcatcggtctcaaggaaaaactagccgaagccaag

SEQ ID NO: 920 - DNA, 200 bp, Amaranthus viridis
cttggcttcggctagtttttccttgagaccgatgagttgttggtcaagccttcccatacactcgagaagttccttggttcggaacttaatctcgatcattccttccggttcaagcacatttcctttagctgtttggtcggcgtacatttctatatggtcggaattaattcgactatcgacgaccacccatgcgcctcctc

SEQ ID NO: 921 - DNA, 200 bp, Amaranthus viridis
caaggaaaaactagccgaagccaagagctctaattcctacgataaaatcgagcccctgcagcaacaaataaaagcccgcgagaagcaactattgcctctttatactcagatagccaccaaatttgccgagttgcatgatacgtctttaaggatggctgccaaaggagtcattagggacgtcttggaatggaaaagctcgc

SEQ ID NO: 922 - DNA, 200 bp, Amaranthus viridis
gcgagcttttccattccaagacgtccctaatgactcctttggcagccatccttaaagacgtatcatgcaactcggcaaatttggtggctatctgagtataaagaggcaatagttgcttctcgcgggcttttatttgttgctgcaggggctcgattttatcgtaggaattagagctcttggcttcggctagtttttccttg

SEQ ID NO: 923 - DNA, 200 bp, Amaranthus viridis
gacgtcttggaatggaaaagctcgcgttcgttcttttacaaaagattatacaggagagttatggaggaatcactcgtcaagactgttcgagatgctgcaggtgaacggttgacccataagtcggctttggagttgatccggaaatggttcaatgagtcagatatttccggagaggcttccgatgcttgggctgatgatgc

SEQ ID NO: 924 - DNA, 200 bp, Amaranthus viridis
gcatcatcagcccaagcatcggaagcctctccggaaatatctgactcattgaaccatttccggatcaactccaaagccgacttatgggtcaaccgttcacctgcagcatctcgaacagtcttgacgagtgattcctccataactctcctgtataatcttttgtaaaagaacgaacgcgagcttttccattccaagacgtc

SEQ ID NO: 925 - DNA, 200 bp, Amaranthus viridis
cttccgatgcttgggctgatgatgcgaccttctttaagtggaaggacaataccgctaactacgaggagaagttgaaagagttgcgggttcagaaggtattggatcagctgtcgaatattggagattcggtaactaatttgagggctctgcctcagggtcttgctgccctacttcaaaaggtggatccatcgagtcgagaa

SEQ ID NO: 926 - DNA, 200 bp, Amaranthus viridis
ttctcgactcgatggatccaccttttgaagtagggcagcaagaccctgaggcagagccctcaaattagttaccgaatctccaatattcgacagctgatccaataccttctgaacccgcaactctttcaacttctcctcgtagttagcggtattgtccttccacttaaagaaggtcgcatcatcagcccaagcatcggaag

SEQ ID NO: 927 - DNA, 200 bp, Amaranthus viridis
aaaggtggatccatcgagtcgagaagaactagtcgaggaactccgaaaagtgctcacttgatttcgcaaccgttgatggtgaagtgaaaccttcttggtttcatcatggtagaaaatattattaggcaaatctataattttagtgacatcaattgttttagacaatagtattgaactaatttatttaattaaattgtata

SEQ ID NO: 928 - DNA, 200 bp, Amaranthus viridis
tatacaatttaattaaataaattagttcaatactattgtctaaaacaattgatgtcactaaaattatagatttgcctaataatattttctaccatgatgaaaccaagaaggtttcacttcaccatcaacggttgcgaaatcaagtgagcacttttcggagttcctcgactagttcttctcgactcgatggatccaccttt

SEQ ID NO: 929 - DNA, 200 bp, Ambrosia trifida
aaataccatttcttacattatgaggcaaataaaaaaaaatatcagttacttctaaaagttcatttcattaaataaacaaattatcaaacagcgttcttacgttggtcattttctgtgcataatgttctttttgcttgctattttataaagtggaactgattgttataaatagctgttatattttactttctatgagatgc

SEQ ID NO: 930 - DNA, 200 bp, Ambrosia trifida
gcatctcatagaaagtaaaatataacagctatttataacaatcagttccactttataaaatagcaagcaaaaagaacattatgcacagaaaatgaccaacgtaagaacgctgtttgataatttgtttatttaatgaaatgaacttttagaagtaactgatatttttttttatttgcctcataatgtaagaaatggtattt

SEQ ID NO: 931 - DNA, 200 bp, Ambrosia trifida
ttatattttactttctatgagatgcatacatatgatatttttagtgttttgaaatcgtaaatatgattttatgaaatgttgaggttttggaaggattataagacttgcccaaaggtttgttttcattatctaacatattgacttgaattgcacttttgtaggagcttagtttcaaaagcaagccaaatgtgtgggcatac

SEQ ID NO: 932 - DNA, 200 bp, Ambrosia trifida
gtatgcccacacatttggcttgcttttgaaactaagctcctacaaaagtgcaattcaagtcaatatgttagataatgaaaacaaacctttgggcaagtcttataatccttccaaaacctcaacatttcataaaatcatatttacgatttcaaaacactaaaaatatcatatgtatgcatctcatagaaagtaaaatataa

SEQ ID NO: 933 - DNA, 200 bp, Ambrosia trifida
aagcaagccaaatgtgtgggcatacttttctgtcaaggtaaatttatatttacatattttgatgcaatttcccaattcaaaaatataaatatatttttatttaaaaattgcagtccggaggaggcattcatgaattctcagattctcaatttggtaagaaaactgaatcttgtttggttttagtttttaacagtcatact

SEQ ID NO: 934 - DNA, 200 bp, Ambrosia trifida
agtatgactgttaaaaactaaaaccaaacaagattcagttttcttaccaaattgagaatctgagaattcatgaatgcctcctccggactgcaatttttaaataaaaatatatttatatttttgaattgggaaattgcatcaaaatatgtaaatataaatttaccttgacagaaaagtatgcccacacatttggcttgctt

SEQ ID NO: 935 - DNA, 200 bp, Ambrosia trifida
ggttttagtttttaacagtcatactgctggtgtagttggctttacacgattctttgctaaagcattcgttatcttatttaattattattttgtacgctttaggtcatgtttttgcatttggagagtcaagagcactggccattgcaaatatggttcttgggttgaaagaaatccaaattcgtggtgaaatccgtactaat

SEQ ID NO: 936 - DNA, 200 bp, Ambrosia trifida
attagtacggatttcaccacgaatttggatttctttcaacccaagaaccatatttgcaatggccagtgctcttgactctccaaatgcaaaaacatgacctaaagcgtacaaaataataattaaataagataacgaatgctttagcaaagaatcgtgtaaagccaactacaccagcagtatgactgttaaaaactaaaacc

SEQ ID NO: 937 - DNA, 200 bp, Ambrosia trifida
aattcgtggtgaaatccgtactaatgttgattatacaatcgacttattacatgtgagcatcttggttcttttgctccctttgttccaaattttattgcctacaaaaagtactccataatttaagaaatgcacaagcaaatcagattttaatcagcagagtgccagtttaccctgaatgcatctaaaatacggtaaaattt

SEQ ID NO: 938 - DNA, 200 bp, Ambrosia trifida
aaattttaccgtattttagatgcattcagggtaaactggcactctgctgattaaaatctgatttgcttgtgcatttcttaaattatggagtactttttgtaggcaataaaatttggaacaaagggagcaaaagaaccaagatgctcacatgtaataagtcgattgtataatcaacattagtacggatttcaccacgaatt

SEQ ID NO: 939 - DNA, 200 bp, Ambrosia trifida
atgcatctaaaatacggtaaaattttaagataagtgtaatcaagggtgaaactagaaaactaataaattacaacatttcatttctagaacaggacagttattatgatacaaattaaaaaagaaaagtagacaaattttgagacgggtcgactgtcatgaagttaatagattacatacgttttttttacagaattacttat

SEQ ID NO: 940 - DNA, 200 bp, Ambrosia trifida
ataagtaattctgtaaaaaaaacgtatgtaatctattaacttcatgacagtcgacccgtctcaaaatttgtctacttttcttttttaatttgtatcataataactgtcctgttctagaaatgaaatgttgtaatttattagttttctagtttcacccttgattacacttatcttaaaattttaccgtattttagatgcat

SEQ ID NO: 941 - DNA, 200 bp, Ambrosia trifida
acgttttttttacagaattacttatgtacatgcttcatattgagaaattgattaaatttacaaattctttatttcttgtacattagctttatgattttgattcttttacacttaataattttattattattatttctacatttgtaggctccggattatagcgaaaacaaaatccatacaggttggttagatagccgaat

SEQ ID NO: 942 - DNA, 200 bp, Ambrosia trifida
attcggctatctaaccaacctgtatggattttgttttcgctataatccggagcctacaaatgtagaaataataataataaaattattaagtgtaaaagaatcaaaatcataaagctaatgtacaagaaataaagaatttgtaaatttaatcaatttctcaatatgaagcatgtacataagtaattctgtaaaaaaaacgt

SEQ ID NO: 943 - DNA, 200 bp, Ambrosia trifida
atacaggttggttagatagccgaattgctatgcgggttagagcagaaaggcccccatggtacctttcagtagttggtggagctctttatgtaagtggtttgttaataatacttttccttttctatattcaccaccgtttaatgtactcttgtcttactgttgatttttgttgacctcagaaagctgctgctagaagtgca

SEQ ID NO: 944 - DNA, 200 bp, Ambrosia trifida
tgcacttctagcagcagctttctgaggtcaacaaaaatcaacagtaagacaagagtacattaaacggtggtgaatatagaaaaggaaaagtattattaacaaaccacttacataaagagctccaccaactactgaaaggtaccatgggggcctttctgctctaacccgcatagcaattcggctatctaaccaacctgtat

SEQ ID NO: 945 - DNA, 200 bp, Ambrosia trifida
tcagaaagctgctgctagaagtgcagccatggtatcagattatgttggttatcttgaaaagggtcaaatccctcctaaggtattttgacttagcattgacctttatgttgacctcagaatgccctttgcttaatttttttttcttttcttgaagcatatatcattggtcaactctcaagtttctttgaatattgagggta

SEQ ID NO: 946 - DNA, 200 bp, Ambrosia trifida
taccctcaatattcaaagaaacttgagagttgaccaatgatatatgcttcaagaaaagaaaaaaaaattaagcaaagggcattctgaggtcaacataaaggtcaatgctaagtcaaaataccttaggagggatttgacccttttcaagataaccaacataatctgataccatggctgcacttctagcagcagctttctga

SEQ ID NO: 947 - DNA, 200 bp, Ambrosia trifida
caagtttctttgaatattgagggtagtaagtacacggtaagtaataacataaatttctgttcttgatctctgtttttttttaattattatttttcttctaatttatgtgtttgttttttgtaagattgatatggtaaaaaaaggaccaggaagttacagattaaaaatgaatcactctgagattgaagcagaaatacata

SEQ ID NO: 948 - DNA, 200 bp, Ambrosia trifida
tatgtatttctgcttcaatctcagagtgattcatttttaatctgtaacttcctggtcctttttttaccatatcaatcttacaaaaaacaaacacataaattagaagaaaaataataattaaaaaaaaacagagatcaagaacagaaatttatgttattacttaccgtgtacttactaccctcaatattcaaagaaacttg

SEQ ID NO: 949 - DNA, 200 bp, Ambrosia trifida
tctgagattgaagcagaaatacatactctacgcgatgggggtttgttaatgcaggtaaacatttttgtttatttttcaagttaaagtcctatgggtatgggatacatgatttgcttcataaataaaatcaaaagatacaatatttacagtcatgcaaatttgttacatttttacatgtatttacacatttgtttgtcaca

SEQ ID NO: 950 - DNA, 200 bp, Ambrosia trifida
tgtgacaaacaaatgtgtaaatacatgtaaaaatgtaacaaatttgcatgactgtaaatattgtatcttttgattttatttatgaagcaaatcatgtatcccatacccataggactttaacttgaaaaataaacaaaaatgtttacctgcattaacaaacccccatcgcgtagagtatgtatttctgcttcaatctcaga

SEQ ID NO: 951 - DNA, 200 bp, Ambrosia trifida
tgtatttacacatttgtttgtcacatgcctatatttatataatattgattggataatttaatattgtagttggatggaaatagccatattatatatgcagaggaagaagctgccggtactcgactcctaattgatggacgaacttgcttgcttcaggtgtcaacaactacttctttttgttgttgtttacttctttttgt

SEQ ID NO: 952 - DNA, 200 bp, Ambrosia trifida
acaaaaagaagtaaacaacaacaaaaagaagtagttgttgacacctgaagcaagcaagttcgtccatcaattaggagtcgagtaccggcagcttcttcctctgcatatataatatggctatttccatccaactacaatattaaattatccaatcaatattatataaatataggcatgtgacaaacaaatgtgtaaataca

SEQ ID NO: 953 - DNA, 200 bp, Ambrosia trifida
tttgttgttgtttacttctttttgttgttgttgttattattattattatttattatagatgtggctgtttctatgcatttacttttgagttgattgatttaggtcatatgttatctttaatgggtaaaaaagtttagcctaaaacgagacgggtcagttggatccattaggttgaaagtcacctgtagtttatctattac

SEQ ID NO: 954 - DNA, 200 bp, Ambrosia trifida
gtaatagataaactacaggtgactttcaacctaatggatccaactgacccgtctcgttttaggctaaacttttttacccattaaagataacatatgacctaaatcaatcaactcaaaagtaaatgcatagaaacagccacatctataataaataataataataataacaacaacaacaaaaagaagtaaacaacaacaaa

SEQ ID NO: 955 - DNA, 200 bp, Ambrosia trifida
aagtcacctgtagtttatctattacgcataatgtgattagaccacctgattgcattaaaaaaaatataaaaccctcatttcaatccaaacggactcgtttagacaatcttccatttttgaccaatacccgcccattatcccacatctgtttgttattcactaatttgttctatatttggtttaatttgttgttagaatga

SEQ ID NO: 956 - DNA, 200 bp, Ambrosia trifida
tcattctaacaacaaattaaaccaaatatagaacaaattagtgaataacaaacagatgtgggataatgggcgggtattggtcaaaaatggaagattgtctaaacgagtccgtttggattgaaatgagggttttatattttttttaatgcaatcaggtggtctaatcacattatgcgtaatagataaactacaggtgactt

SEQ ID NO: 957 - DNA, 200 bp, Ambrosia trifida
ttggtttaatttgttgttagaatgatcatgatccttccaagttgatggcagaaacgccatgcaagcttctaagatacttagtgtctgatggtagccatgttgatgctgacacaccttatgttgaggttgaagtgatgaaaatgtgtatgccacttctttcgccggcttctggagttatacaatttaaaatgtccgaaggt

SEQ ID NO: 958 - DNA, 200 bp, Ambrosia trifida
accttcggacattttaaattgtataactccagaagccggcgaaagaagtggcatacacattttcatcacttcaacctcaacataaggtgtgtcagcatcaacatggctaccatcagacactaagtatcttagaagcttgcatggcgtttctgccatcaacttggaaggatcatgatcattctaacaacaaattaaaccaa

SEQ ID NO: 959 - DNA, 200 bp, Ambrosia trifida
tatacaatttaaaatgtccgaaggtcaagccatgcaggttagatttaaatatcttcttaatatttattgtttttgcgaaatatatacaaaaatttccttttacgaacattaatgaaaaatcaattctgaatctacatgagaatttaatttatttatttttttatatatggacatcttttctgagtaaaattttggcattg

SEQ ID NO: 960 - DNA, 200 bp, Ambrosia trifida
caatgccaaaattttactcagaaaagatgtccatatataaaaaaataaataaattaaattctcatgtagattcagaattgatttttcattaatgttcgtaaaaggaaatttttgtatatatttcgcaaaaacaataaatattaagaagatatttaaatctaacctgcatggcttgaccttcggacattttaaattgtata

SEQ ID NO: 961 - DNA, 200 bp, Ambrosia trifida
ttttctgagtaaaattttggcattgtagttgttttttctttattttataactctaactttttcaaaaaggtaatatctaagatatttagaggcataatgagtcactttttacaattaatattattcccaattgtttcagttacaaatattatattggtacgtcagtgctcgattttttgttgtttacacaaattctctcc

SEQ ID NO: 962 - DNA, 200 bp, Ambrosia trifida
ggagagaatttgtgtaaacaacaaaaaatcgagcactgacgtaccaatataatatttgtaactgaaacaattgggaataatattaattgtaaaaagtgactcattatgcctctaaatatcttagatattacctttttgaaaaagttagagttataaaataaagaaaaaacaactacaatgccaaaattttactcagaaaa

SEQ ID NO: 963 - DNA, 200 bp, Ambrosia trifida
tttgttgtttacacaaattctctccataatacaatcatatctttatcttctatacagcatgcatacatgggatgcactttttgtcctaaattttgaacatatgaatgtttttatatgtaggctggtgagcttatagcaagactagatcttgatgatccgtcagctgtaagaaaagcagagccctttcctggaagctttcc

SEQ ID NO: 964 - DNA, 200 bp, Ambrosia trifida
ggaaagcttccaggaaagggctctgcttttcttacagctgacggatcatcaagatctagtcttgctataagctcaccagcctacatataaaaacattcatatgttcaaaatttaggacaaaaagtgcatcccatgtatgcatgctgtatagaagataaagatatgattgtattatggagagaatttgtgtaaacaacaaa

SEQ ID NO: 965 - DNA, 200 bp, Ambrosia trifida
cagagccctttcctggaagctttcctgttctgggcccaccgaccgccatttcagataaagttcatctgaaatgtgctgcaactctgaatgctgctcggatgattcttgctggctatgatgacaacattgatgaagtaatcttgtttttattttattctttttgccatttaaataacccatatgaaatattttaatcaact

SEQ ID NO: 966 - DNA, 200 bp, Ambrosia trifida
agttgattaaaatatttcatatgggttatttaaatggcaaaaagaataaaataaaaacaagattacttcatcaatgttgtcatcatagccagcaagaatcatccgagcagcattcagagttgcagcacatttcagatgaactttatctgaaatggcggtcggtgggcccagaacaggaaagcttccaggaaagggctctg

SEQ ID NO: 967 - DNA, 200 bp, Ambrosia trifida
cccatatgaaatattttaatcaactaatcacaactttatgtagtggtgaaaaatttaacccacaatttatgaacgggtcgacttgggttatgttgatccataagtggtcaaacacaaaaatagaaatgctcaaaagataatggtcatatgggtcaagtcagccaaagtgtattcttatgcataaaacctcctaaatcatt

SEQ ID NO: 968 - DNA, 200 bp, Ambrosia trifida
aatgatttaggaggttttatgcataagaatacactttggctgacttgacccatatgaccattatcttttgagcatttctatttttgtgtttgaccacttatggatcaacataacccaagtcgacccgttcataaattgtgggttaaatttttcaccactacataaagttgtgattagttgattaaaatatttcatatggg

SEQ ID NO: 969 - DNA, 200 bp, Ambrosia trifida
tatgcataaaacctcctaaatcatttttattcaaaaaaattaacttcttttaataatataaattttggaatagtatttgatatgctaattatatataactaaatttagtttttgaacaagtgttaagggtcaagcaagcctaacttgctttgattgacacaaaattatgcattattccataccggttttgactcgtgacc

SEQ ID NO: 970 - DNA, 200 bp, Ambrosia trifida
ggtcacgagtcaaaaccggtatggaataatgcataattttgtgtcaatcaaagcaagttaggcttgcttgacccttaacacttgttcaaaaactaaatttagttatatataattagcatatcaaatactattccaaaatttatattattaaaagaagttaatttttttgaataaaaatgatttaggaggttttatgcata

SEQ ID NO: 971 - DNA, 200 bp, Ambrosia trifida
tccataccggttttgactcgtgacccatcccgccaagtcgttcttttttctcaccattagcttagttcttcaatgagcttactttcttttaaatttttctttttgttatttataacatgtttaatctttgattttaggttgtgcaaaacctgcttctttgtctggatagtcctgagcttcctttccttcaatggcaagaa

SEQ ID NO: 972 - DNA, 200 bp, Ambrosia trifida
ttcttgccattgaaggaaaggaagctcaggactatccagacaaagaagcaggttttgcacaacctaaaatcaaagattaaacatgttataaataacaaaaagaaaaatttaaaagaaagtaagctcattgaagaactaagctaatggtgagaaaaaagaacgacttggcgggatgggtcacgagtcaaaaccggtatgga

SEQ ID NO: 973 - DNA, 200 bp, Ambrosia trifida
gcttcctttccttcaatggcaagaatgctttgcagttctagcaaatcgacttcctaaagatctaagaaacaaggcaaattaatgtcttataatcatgttgtttatttaagttattattgtaacattttttttctaatttttaattcttctataacagttggagtcgaagtttaaggagtacgaaggaatttccacccaac

SEQ ID NO: 974 - DNA, 200 bp, Ambrosia trifida
gttgggtggaaattccttcgtactccttaaacttcgactccaactgttatagaagaattaaaaattagaaaaaaaatgttacaataataacttaaataaacaacatgattataagacattaatttgccttgtttcttagatctttaggaagtcgatttgctagaactgcaaagcattcttgccattgaaggaaaggaagc

SEQ ID NO: 975 - DNA, 200 bp, Ambrosia trifida
gagtacgaaggaatttccacccaacaagctatcgaattccccgccaaagtgttacgggccattctagaagttagtttacgatcaaatacttataatttgacttttttcgtatttaaatatttagtttactttatactatacttttgtaatgtttatggttagacgcaccttggatcttgcttagaaaaagagaaagttgc

SEQ ID NO: 976 - DNA, 200 bp, Ambrosia trifida
gcaactttctctttttctaagcaagatccaaggtgcgtctaaccataaacattacaaaagtatagtataaagtaaactaaatatttaaatacgaaaaaagtcaaattataagtatttgatcgtaaactaacttctagaatggcccgtaacactttggcggggaattcgatagcttgttgggtggaaattccttcgtactc

SEQ ID NO: 977 - DNA, 200 bp, Ambrosia trifida
cttgcttagaaaaagagaaagttgcccaagaaagactcattgaaccgttgatgagtcttgttaagtcatatgaaggtggcagagagagtcatgcacgtgggattgttcatgcactttttgaaaaatatttatccattgaagaattatttagtgacaatattcaggtgaagtttttaactgattagtataaaaaatgcaaa

SEQ ID NO: 978 - DNA, 200 bp, Ambrosia trifida
tttgcattttttatactaatcagttaaaaacttcacctgaatattgtcactaaataattcttcaatggataaatatttttcaaaaagtgcatgaacaatcccacgtgcatgactctctctgccaccttcatatgacttaacaagactcatcaacggttcaatgagtctttcttgggcaactttctctttttctaagcaag

SEQ ID NO: 979 - DNA, 200 bp, Ambrosia trifida
aactgattagtataaaaaatgcaaaatttcatatataaactttatagtatcatatttattttttcaaatttccatggtgaaacaaataacgaatgcaaaagcaatgttattactgtgaatcatgtctacacataatgctcttataagtaattaatttgcatgcactttaacatcatactctttcatgttgagtaaatttt

SEQ ID NO: 980 - DNA, 200 bp, Ambrosia trifida
aaaatttactcaacatgaaagagtatgatgttaaagtgcatgcaaattaattacttataagagcattatgtgtagacatgattcacagtaataacattgcttttgcattcgttatttgtttcaccatggaaatttgaaaaaataaatatgatactataaagtttatatatgaaattttgcattttttatactaatcagtt

SEQ ID NO: 981 - DNA, 200 bp, Ambrosia trifida
tactctttcatgttgagtaaatttttcttaaatgtaaaatgaaatttttttctttaggctgatgtaatcgaacgtctacgactccaatacaacaaagatctcttgaggattgttgacattgtgctttcccatcaggtatatatgttatttttagaggttgcaaaatggactgtgggatgggtttgtcaacgggtcaaaat

SEQ ID NO: 982 - DNA, 200 bp, Ambrosia trifida
attttgacccgttgacaaacccatcccacagtccattttgcaacctctaaaaataacatatatacctgatgggaaagcacaatgtcaacaatcctcaagagatctttgttgtattggagtcgtagacgttcgattacatcagcctaaagaaaaaaatttcattttacatttaagaaaaatttactcaacatgaaagagta

SEQ ID NO: 983 - DNA, 200 bp, Ambrosia trifida
atggggacaaacggtgttgttcatttaacggtttctgacgatctggaaggcgttatggcaatcataaattggttgagctttgttccaccgtatgttggtggcccgcttcctgttttggcagcagtggacccggtagaccggcctgtggagtaccagcctgaaaactcgtgtgatcctcgtgcggctgtttgtggtacagt

SEQ ID NO: 984 - DNA, 200 bp, Ambrosia trifida
actgtaccacaaacagccgcacgaggatcacacgagttttcaggctggtactccacaggccggtctaccgggtccactgctgccaaaacaggaagcgggccaccaacatacggtggaacaaagctcaaccaatttatgattgccataacgccttccagatcgtcagaaaccgttaaatgaacaacaccgtttgtccccat

SEQ ID NO: 985 - DNA, 200 bp, Ambrosia trifida
ctcgtgcggctgtttgtggtacagtggatgggaatgggaaatggttaggagggattttcgatagagacagttttgtggaaacattggagggttgggctaggacggttgtaacgggccgggccaaacttggtgggatccccgtaggggttattgctgtcgagacgcaaacagtgatgcaaataatacctgcggatcctggg

SEQ ID NO: 986 - DNA, 200 bp, Ambrosia trifida
cccaggatccgcaggtattatttgcatcactgtttgcgtctcgacagcaataacccctacggggatcccaccaagtttggcccggcccgttacaaccgtcctagcccaaccctccaatgtttccacaaaactgtctctatcgaaaatccctcctaaccatttcccattcccatccactgtaccacaaacagccgcacgag

SEQ ID NO: 987 - DNA, 200 bp, Ambrosia trifida
gcaaataatacctgcggatcctgggcagctcgactcacacgaacgtgttgtcccgcaagctgggcaggtgtggttccctgattctgctagcaaaactgctcaagctttaatggattttaaccgcgaagagcttccgctgttcatcatggcgaactggcgggggttttctgctggtcaacgggatctttttgaaggaattt

SEQ ID NO: 988 - DNA, 200 bp, Ambrosia trifida
aaattccttcaaaaagatcccgttgaccagcagaaaacccccgccagttcgccatgatgaacagcggaagctcttcgcggttaaaatccattaaagcttgagcagttttgctagcagaatcagggaaccacacctgcccagcttgcgggacaacacgttcgtgtgagtcgagctgcccaggatccgcaggtattatttgc

SEQ ID NO: 989 - DNA, 200 bp, Ambrosia trifida
caacgggatctttttgaaggaattttacaggcgggatcgacaattgttgagaaccttagaacgtataaacagccggttttcgtttacatcccgaaaaccggcgagcttcgtggcggcgcgtgggtggttgttgacagtcgaatcaactcggaccatatagaaatgtatgcagaaacaaccgcaaaaggaaatgttcttga

SEQ ID NO: 990 - DNA, 200 bp, Ambrosia trifida
tcaagaacatttccttttgcggttgtttctgcatacatttctatatggtccgagttgattcgactgtcaacaaccacccacgcgccgccacgaagctcgccggttttcgggatgtaaacgaaaaccggctgtttatacgttctaaggttctcaacaattgtcgatcccgcctgtaaaattccttcaaaaagatcccgttg

SEQ ID NO: 991 - DNA, 200 bp, Ambrosia trifida
caaccgcaaaaggaaatgttcttgaacccgaaggtatgattgaaattaagttccgaaacaaggaattgttagaatgtatgaaccgactggacccgcaaatccgaaacctcaaacaaaaattacaagaaacaaaatacgaccaaacaatcaccgaccagataaaagcccgtgagaagcaacttctgcccatttacactcag

SEQ ID NO: 992 - DNA, 200 bp, Ambrosia trifida
ctgagtgtaaatgggcagaagttgcttctcacgggcttttatctggtcggtgattgtttggtcgtattttgtttcttgtaatttttgtttgaggtttcggatttgcgggtccagtcggttcatacattctaacaattccttgtttcggaacttaatttcaatcataccttcgggttcaagaacatttccttttgcggttg

SEQ ID NO: 993 - DNA, 200 bp, Ambrosia trifida
gcaacttctgcccatttacactcagatcgccaccaagttcgcggagcttcacgacacatctttccgaatggctgaaaaaggcgtggtgaaaaaggttgttgactggaacatttctcggtttttcttctacaaaaggctgcggcgtaggctgggggaggcttctttgataagtagcatgcgtgatgctgcgggtgggacgc

SEQ ID NO: 994 - DNA, 200 bp, Ambrosia trifida
gcgtcccacccgcagcatcacgcatgctacttatcaaagaagcctcccccagcctacgccgcagccttttgtagaagaaaaaccgagaaatgttccagtcaacaacctttttcaccacgcctttttcagccattcggaaagatgtgtcgtgaagctccgcgaacttggtggcgatctgagtgtaaatgggcagaagttgc

SEQ ID NO: 995 - DNA, 200 bp, Ambrosia trifida
atgcgtgatgctgcgggtgggacgctgtcgtacaagtcggcttatgatatgattaagaaatggtttctggagagcaaaggggaagcagagttgtgggttgatgatgatgcttttttcacatggaaagatgaaccaaagaactacaggcacaagttaagtgagttacgtgcacgcaaggttgcaaatgagttattaaagat

SEQ ID NO: 996 - DNA, 200 bp, Ambrosia trifida
atctttaataactcatttgcaaccttgcgtgcacgtaactcacttaacttgtgcctgtagttctttggttcatctttccatgtgaaaaaagcatcatcatcaacccacaactctgcttcccctttgctctccagaaaccatttcttaatcatatcataagccgacttgtacgacagcgtcccacccgcagcatcacgcat

SEQ ID NO: 997 - DNA, 200 bp, Ambrosia trifida
aggttgcaaatgagttattaaagattggtggttcagcgtcggatgtggaagcgttggcgcaggggctggctgcacttctaaaagaggtaactgttgtttcttgaatcttgacgactacattcctttcaccattttgcaagtcgagaataagattgtttttaatgtcgttttgtttgttgtgtttcaggtggatccagcga

SEQ ID NO: 998 - DNA, 200 bp, Ambrosia trifida
tcgctggatccacctgaaacacaacaaacaaaacgacattaaaaacaatcttattctcgacttgcaaaatggtgaaaggaatgtagtcgtcaagattcaagaaacaacagttacctcttttagaagtgcagccagcccctgcgccaacgcttccacatccgacgctgaaccaccaatctttaataactcatttgcaacct

SEQ ID NO: 999 - DNA, 200 bp, Ambrosia trifida
gttgtgtttcaggtggatccagcgactaaaagtaaactaattgaagacatccggcgtgtcattgagacttggccggctaaatgagaagccattcgggcaatgtatactatttagaactactacatgtaagaatatttattttccttgaatatttttgtaaataaatcacacatttccaatcatatcaaataattattcat

SEQ ID NO: 1000 - DNA, 200 bp, Ambrosia trifida
atgaataattatttgatatgattggaaatgtgtgatttatttacaaaaatattcaaggaaaataaatattcttacatgtagtagttctaaatagtatacattgcccgaatggcttctcatttagccggccaagtctcaatgacacgccggatgtcttcaattagtttacttttagtcgctggatccacctgaaacacaac

SEQ ID NO: 1001 - DNA, 200 bp, Ambrosia trifida
ccaatcatatcaaataattattcattgtagtcttttctgtaatcggtatttgcgatatctatgtttgagtatttgtgaaccttttattaactaattatacaaatctttgttgggctttgcactttctggatcaacaactcagacctcgtgatcaagctttggtgaacatgaatgaactgcatctgcaacagtgagaaaaa

SEQ ID NO: 1002 - DNA, 200 bp, Ambrosia trifida
tttttctcactgttgcagatgcagttcattcatgttcaccaaagcttgatcacgaggtctgagttgttgatccagaaagtgcaaagcccaacaaagatttgtataattagttaataaaaggttcacaaatactcaaacatagatatcgcaaataccgattacagaaaagactacaatgaataattatttgatatgattgg

SEQ ID NO: 1003 - DNA, 200 bp, Ambrosia trifida
actgcatctgcaacagtgagaaaaatcttgttttccccaatcaagtcggggaaacctgatgcgtatagcttgtctagcacttgttgacccgggttcgcaagaataagctgtcaaaccaaaatattattgttttagcacgcaattgcggaaattattatgaaaactttttatccgttgttaacgtataataaatgagttga

SEQ ID NO: 1004 - DNA, 200 bp, Ambrosia trifida
tcaactcatttattatacgttaacaacggataaaaagttttcataataatttccgcaattgcgtgctaaaacaataatattttggtttgacagcttattcttgcgaacccgggtcaacaagtgctagacaagctatacgcatcaggtttccccgacttgattggggaaaacaagatttttctcactgttgcagatgcagt

SEQ ID NO: 1005 - DNA, 200 bp, Ambrosia trifida
tgttaacgtataataaatgagttgatgatatgtgtagtagtgtttaatcgcataaaattacatgttttgttctcaactggttttggcacgtttacttgtaatattataaacagtattgctgctgcttacttggacatctctcttttgcagactacggtataactcttccaaggcatggattccacttgtgtcgatatcag

SEQ ID NO: 1006 - DNA, 200 bp, Ambrosia trifida
ctgatatcgacacaagtggaatccatgccttggaagagttataccgtagtctgcaaaagagagatgtccaagtaagcagcagcaatactgtttataatattacaagtaaacgtgccaaaaccagttgagaacaaaacatgtaattttatgcgattaaacactactacacatatcatcaactcatttattatacgttaaca

SEQ ID NO: 1007 - DNA, 200 bp, Ambrosia trifida
tggattccacttgtgtcgatatcagtaaccgctgcagttagagaacactctttaaacaaagtattcgccccgctcattaaatataggaaatagaagagcttctttcttacgtgacaattccactatcaagaactgaattttgggttgaaaagttgctgcttttagattatcttcttcctcagctagccatcttaatatcc

SEQ ID NO: 1008 - DNA, 200 bp, Ambrosia trifida
ggatattaagatggctagctgaggaagaagataatctaaaagcagcaacttttcaacccaaaattcagttcttgatagtggaattgtcacgtaagaaagaagctcttctatttcctatatttaatgagcggggcgaatactttgtttaaagagtgttctctaactgcagcggttactgatatcgacacaagtggaatcca

SEQ ID NO: 1009 - DNA, 200 bp, Ambrosia trifida
tcctcagctagccatcttaatatcctgcaacgaattatagctttcaaggatggaaacctacatacacacatagttaaaatccgatggtttgtacctttctttgatgtaatttgaatttgagaaataaatagcagaatcaatcctaacaattacaacacccggaattttattcgcttctggatactgtccgatattccggt

SEQ ID NO: 1010 - DNA, 200 bp, Ambrosia trifida
accggaatatcggacagtatccagaagcgaataaaattccgggtgttgtaattgttaggattgattctgctatttatttctcaaattcaaattacatcaaagaaaggtacaaaccatcggattttaactatgtgtgtatgtaggtttccatccttgaaagctataattcgttgcaggatattaagatggctagctgagga

SEQ ID NO: 1011 - DNA, 200 bp, Ambrosia trifida
tctggatactgtccgatattccggtacacgctggtcatcggaatcttcccaagaagcgcggttcgtgggcgtgtaacttgcagaagaatcttagcaaaagatatcgccacctgattcaacaatcttattaaacaaaagctcaaaattgacctaaaaacaatgttttcataaccagttcaatggttgggcccaaatgccat

SEQ ID NO: 1012 - DNA, 200 bp, Ambrosia trifida
atggcatttgggcccaaccattgaactggttatgaaaacattgtttttaggtcaattttgagcttttgtttaataagattgttgaatcaggtggcgatatcttttgctaagattcttctgcaagttacacgcccacgaaccgcgcttcttgggaagattccgatgaccagcgtgtaccggaatatcggacagtatccaga

SEQ ID NO: 1013 - DNA, 200 bp, Ambrosia trifida
cagttggaatgggaattccactttggcaaataccagaaattagacggttttatgggatggataatagtggaggttatgatgcttggagaaaaacatcggctcttgcaaccccttttgactttgaccaagcagagtcaattagaccaaggggtcattgtattgctgttcgtgtaacgagtgaggatccagatgatggtttt

SEQ ID NO: 1014 - DNA, 200 bp, Ambrosia trifida
aaaaccatcatctggatcctcactcgttacacgaacagcaatacaatgaccccttggtctaattgactctgcttggtcaaagtcaaaaggggttgcaagagccgatgtttttctccaagcatcataacctccactattatccatcccataaaaccgtctaatttctggtatttgccaaagtggaattcccattccaactg

SEQ ID NO: 1015 - DNA, 200 bp, Ambrosia trifida
gagtgaggatccagatgatggttttaagccaccggtggaaaagtacaggaactagttttaaaagcaagccaaatgtgtgggcatacttttctgtcaagtctggaggaggcattcatgaattttcggattcccaatttggtcatgtttttgcatttggagagtcaagaacgttggctattgcaaatatggttcttgggctg

SEQ ID NO: 1016 - DNA, 200 bp, Ambrosia trifida
cagcccaagaaccatatttgcaatagccaacgttcttgactctccaaatgcaaaaacatgaccaaattgggaatccgaaaattcatgaatgcctcctccagacttgacagaaaagtatgcccacacatttggcttgcttttaaaactagttcctgtacttttccaccggtggcttaaaaccatcatctggatcctcactc

SEQ ID NO: 1017 - DNA, 200 bp, Ambrosia trifida
tattgcaaatatggttcttgggctgaaggaaatccaaattcgtggagaaattcgtactaatgttgattatacaatcgatctattacatgctctggattatagagaaaacaaaatccatacaggttggttagatagccgaattgctatgcgggttagagcagaaaggcccccatggtacctttcagtagttggtggagctc

SEQ ID NO: 1018 - DNA, 200 bp, Ambrosia trifida
gagctccaccaactactgaaaggtaccatgggggcctttctgctctaacccgcatagcaattcggctatctaaccaacctgtatggattttgttttctctataatccagagcatgtaatagatcgattgtataatcaacattagtacgaatttctccacgaatttggatttccttcagcccaagaaccatatttgcaata

SEQ ID NO: 1019 - DNA, 200 bp, Ambrosia trifida
tacctttcagtagttggtggagctctttataaagctgctgctagaagtgctttacatggtttctgactatgttggttatcttgaaaagggtcaaatccctcctaagcatatatcattggtcaactctcaagtttctttgaatattgagggtagtaagatacacgattgatatgctgaaaagaggaccaggaagttacaga

SEQ ID NO: 1020 - DNA, 200 bp, Ambrosia trifida
tctgtaacttcctggtcctcttttcagcatatcaatcgtgtatcttactaccctcaatattcaaagaaacttgagagttgaccaatgatatatgcttaggagggatttgacccttttcaagataaccaacatagtcagaaaccatgtaaagcacttctagcagcagctttataaagagctccaccaactactgaaaggta

SEQ ID NO: 1021 - DNA, 200 bp, Ambrosia trifida
gaaaagaggaccaggaagttacagactgagaatgaatcaatctgaaattgaagcagaaatacatactctacgtgatgggggtttactgatgcagttggatggaaatagtcatattatatacgcagaggaagaagcagctggtactcgtcttctaattgatggacgaacttgcttgcttcagaatgatcatgatccttcca

SEQ ID NO: 1022 - DNA, 200 bp, Ambrosia trifida
tggaaggatcatgatcattctgaagcaagcaagttcgtccatcaattagaagacgagtaccagctgcttcttcctctgcgtatataatatgactatttccatccaactgcatcagtaaacccccatcacgtagagtatgtatttctgcttcaatttcagattgattcattctcagtctgtaacttcctggtcctcttttc

SEQ ID NO: 1023 - DNA, 200 bp, Ambrosia trifida
cttcagaatgatcatgatccttccaaattggtggcggaaacaccatgcaagcttctaagatatttagtctcagatggtagccatgttgatgctgacacaccttatgttgaggttgaagtgatgaaaatgtgtatgccacttctttcgccggcttctggagttatacaatttaaaatgtccgaaggtcaagccatgcaggc

SEQ ID NO: 1024 - DNA, 200 bp, Ambrosia trifida
gcctgcatggcttgaccttcggacattttaaattgtataactccagaagccggcgaaagaagtggcatacacattttcatcacttcaacctcaacataaggtgtgtcagcatcaacatggctaccatctgagactaaatatcttagaagcttgcatggtgtttccgccaccaatttggaaggatcatgatcattctgaag

SEQ ID NO: 1025 - DNA, 200 bp, Ambrosia trifida
tgtccgaaggtcaagccatgcaggctggtgagcttatagcaagactagatcttgatgatccgtcagctgtaagaaaagcagagccctttcctggaagctttcctgttctgggcccaccgaccgccatttcagataaagttcatctgaaatgtgctgcaactctgaatgctgctcggatgattcttgctggctatgatgac

SEQ ID NO: 1026 - DNA, 200 bp, Ambrosia trifida
gtcatcatagccagcaagaatcatccgagcagcattcagagttgcagcacatttcagatgaactttatctgaaatggcggtcggtgggcccagaacaggaaagcttccaggaaagggctctgcttttcttacagctgacggatcatcaagatctagtcttgctataagctcaccagcctgcatggcttgaccttcggaca

SEQ ID NO: 1027 - DNA, 200 bp, Ambrosia trifida
gatgattcttgctggctatgatgacaacattgatgatgttgtacaaaatctgcttctttgtctggatagcccggagcttcctttcctacaatggcaagaatgcttcgcagtattagcaaatcgacttgataaagatctaagaaacaagctagaatcaaagtttaaggagtacgaaggaatttccactcaacaagctatcg

SEQ ID NO: 1028 - DNA, 200 bp, Ambrosia trifida
cgatagcttgttgagtggaaattccttcgtactccttaaactttgattctagcttgtttcttagatctttatcaagtcgatttgctaatactgcgaagcattcttgccattgtaggaaaggaagctccgggctatccagacaaagaagcagattttgtacaacatcatcaatgttgtcatcatagccagcaagaatcatc

SEQ ID NO: 1029 - DNA, 200 bp, Ambrosia trifida
ggaatttccactcaacaagctatcgacttccccgccaaagttttacggaacattctagaaactcacctcggatcttgctcagaaaaagagaaggtggcccaggaaagactcattgaaccgttaatgagtctcgttaagtcatatgacggtggtagagagagtcatgcacgcgggattgttcatgctctttttgaagagta

SEQ ID NO: 1030 - DNA, 200 bp, Ambrosia trifida
tactcttcaaaaagagcatgaacaatcccgcgtgcatgactctctctaccaccgtcatatgacttaacgagactcattaacggttcaatgagtctttcctgggccaccttctctttttctgagcaagatccgaggtgagtttctagaatgttccgtaaaactttggcggggaagtcgatagcttgttgagtggaaattcc

SEQ ID NO: 1031 - DNA, 200 bp, Ambrosia trifida
ttgttcatgctctttttgaagagtatttatctgttgaagaattatttagtgacaatattcaggctgatgtaatcgaacgtctacgactccaatacaacaaagatctcttgaggattgttgacattgtgctttcccatcagggagttaggagtaaaaacaagctgatactacgactgatggagcatttggtctaccctaat

SEQ ID NO: 1032 - DNA, 200 bp, Ambrosia trifida
attagggtagaccaaatgctccatcagtcgtagtatcagcttgtttttactcctaactccctgatgggaaagcacaatgtcaacaatcctcaagagatctttgttgtattggagtcgtagacgttcgattacatcagcctgaatattgtcactaaataattcttcaacagataaatactcttcaaaaagagcatgaacaa

SEQ ID NO: 1033 - DNA, 200 bp, Ambrosia trifida
gatggagcatttggtctaccctaatccagctccttatagagagaaactcatacggttttctgcactcaaccacacaagttattctgagttagcattgaaggcaagtcaattgctggaacaaactaaattaagtgaacttcgttcaagtattgcaagaagtctatctgaattagaaatgtttaccgaagaaggtgagaata

SEQ ID NO: 1034 - DNA, 200 bp, Ambrosia trifida
tattctcaccttcttcggtaaacatttctaattcagatagacttcttgcaatacttgaacgaagttcacttaatttagtttgttccagcaattgacttgccttcaatgctaactcagaataacttgtgtggttgagtgcagaaaaccgtatgagtttctctctataaggagctggattagggtagaccaaatgctccatc

SEQ ID NO: 1035 - DNA, 200 bp, Ambrosia trifida
atgtttaccgaagaaggtgagaatatcgatacccctaaaagaaaaagtgcaattaacgaaagaatggaggatatcgtgagtgctcctttggcggttgaagatgcccttgttggtctttttgaccatagtgatcacacccttcaaaggcgtgttgttgagacctatgttagaagattatatcagccatatctggtgaaggg

SEQ ID NO: 1036 - DNA, 200 bp, Ambrosia trifida
cccttcaccagatatggctgatataatcttctaacataggtctcaacaacacgcctttgaagggtgtgatcactatggtcaaaaagaccaacaagggcatcttcaaccgccaaaggagcactcacgatatcctccattctttcgttaattgcactttttcttttaggggtatcgatattctcaccttcttcggtaaacat

SEQ ID NO: 1037 - DNA, 200 bp, Ambrosia trifida
catgatgagtgatgacatatgtggtctttcactctaattcttgcaattgtcgatgctttcgactcttgtcttctttacggtaattagtcttcttcccctttcccccaaatttaaaaaagaaactaaagtttgatagctctgtttggcagtggaagcatgtcagaagctcaaagactgcctttaaatggaagcagcttaaa

SEQ ID NO: 1038 - DNA, 200 bp, Ambrosia trifida
tttaagctgcttccatttaaaggcagtctttgagcttctgacatgcttccactgccaaacagagctatcaaactttagtttcttttttaaatttgggggaaaggggaagaagactaattaccgtaaagaagacaagagtcgaaagcatcgacaattgcaagaattagagtgaaagaccacatatgtcatcactcatcatg

SEQ ID NO: 1039 - DNA, 200 bp, Ambrosia trifida
tgcctttaaatggaagcagcttaaactacaacatttccttgaggtcttctgcagctagatctgctgccattgatgagttttgttatgcacttggtggaaataggcccattcataatattcttgttgcaaacaatggaatggcggcagtaaagcttataagaaatgtgagaacatggaggtatgaaacatttggttcagaa

SEQ ID NO: 1040 - DNA, 200 bp, Ambrosia trifida
ttctgaaccaaatgtttcatacctccatgttctcacatttcttataagctttactgccgccattccattgtttgcaacaagaatattatgaatgggcctatttccaccaagtgcataacaaaactcatcaatggcagcagatctagctgcagaagacctcaaggaaatgttgtagtttaagctgcttccatttaaaggca

SEQ ID NO: 1041 - DNA, 200 bp, Ambrosia trifida
gaggtatgaaacatttggttcagaaaaagcaattttgttggtagccatggctaccccggaggatatgaggataaatgcagagcatattagaattgttggtcaatttgtagaagtgcctggtggaacaaataatgataataatgcaaacgtgcaactcattgtagaggtatataggtttcatacatatataatttatttag

SEQ ID NO: 1042 - DNA, 200 bp, Ambrosia trifida
ctaaataaattatatatgtatgaaacctatatacctctacaatgagttgcacgtttgcattattatcattatttgttccaccaggcacttctacaaattgaccaacaattctaatatgctctgcatttatcctcatatcctccggggtagccatggctaccaacaaaattgctttttctgaaccaaatgtttcatacctc

SEQ ID NO: 1043 - DNA, 200 bp, Ambrosia trifida
tttcatacatatataatttatttaggcatcaactgatgtattttatgaaccaccatacacgccattttattgcaaagtaaccattgttctttagaacagtcttattttgacttttcggtcaaattatctgtttataaacgttcattcctgcaacgataagtcagatatgatggttcaagaagtcggtcactaaacaaggg

SEQ ID NO: 1044 - DNA, 200 bp, Ambrosia trifida
cccttgtttagtgaccgacttcttgaaccatcatatctgacttatcgttgcaggaatgaacgtttataaacagataatttgaccgaaaagtcaaaataagactgttctaaagaacaatggttactttgcaataaaatggcgtgtatggtggttcataaaatacatcagttgatgcctaaataaattatatatgtatgaaa

SEQ ID NO: 1045 - DNA, 200 bp, Ambrosia trifida
caagaagtcggtcactaaacaagggttggatttaccttcacttattcagaagtccttaaaatattacatttgctctctacaaagtattttttactatgaattttcaagtggactacatcaattttgtaattaatacgaaattacaaatgtgtgtaacttttgatgaaaaatcctactttgacatacctaactatatcctt

SEQ ID NO: 1046 - DNA, 200 bp, Ambrosia trifida
aaggatatagttaggtatgtcaaagtaggatttttcatcaaaagttacacacatttgtaatttcgtattaattacaaaattgatgtagtccacttgaaaattcatagtaaaaaatactttgtagagagcaaatgtaatattttaaggacttctgaataagtgaaggtaaatccaacccttgtttagtgaccgacttcttg

SEQ ID NO: 1047 - DNA, 200 bp, Ambrosia trifida
ctttgacatacctaactatatccttaagttataacattgatattgcaatgcttaacttttgaggaaaatcattacctacatcatgtttaatgattgcagactgctgagataacacatgtcgatgcggtttggcctggttggggtcatgcatctgaaatccctgaactaccagacgcattggaggccaaaggaattgtatt

SEQ ID NO: 1048 - DNA, 200 bp, Ambrosia trifida
aatacaattcctttggcctccaatgcgtctggtagttcagggatttcagatgcatgaccccaaccaggccaaaccgcatcgacatgtgttatctcagcagtctgcaatcattaaacatgatgtaggtaatgattttcctcaaaagttaagcattgcaatatcaatgttataacttaaggatatagttaggtatgtcaaag

SEQ ID NO: 1049 - DNA, 200 bp, Ambrosia trifida
cattggaggccaaaggaattgtatttcttggcccccctgcttcatccatggcggctttaggagataaaattggttcttctttgattgcacaagcggctgctgtaccaacacttccatggagtggttctcatgtaaatattgccacttttatagtcggtcctttttagttttttcagaaaaaaaaaactcatttcatacct

SEQ ID NO: 1050 - DNA, 200 bp, Ambrosia trifida
aggtatgaaatgagttttttttttctgaaaaaactaaaaaggaccgactataaaagtggcaatatttacatgagaaccactccatggaagtgttggtacagcagccgcttgtgcaatcaaagaagaaccaattttatctcctaaagccgccatggatgaagcaggggggccaagaaatacaattcctttggcctccaatg

SEQ ID NO: 1051 - DNA, 200 bp, Ambrosia trifida
gcagattattcctgcagatcctgggcaacttgattcacatgaacgggtggtcccacaagctgggcaggtgtggttcccggactctgctagtaaaacggctcaagctataatggattttaaccgagaagagctccctcttttcattatggccaactggcgggggttttcagcgggtcaacgtgacctttttgaagggattt

SEQ ID NO: 1052 - DNA, 200 bp, Ambrosia trifida
aaatcccttcaaaaaggtcacgttgacccgctgaaaacccccgccagttggccataatgaaaagagggagctcttctcggttaaaatccattatagcttgagccgttttactagcagagtccgggaaccacacctgcccagcttgtgggaccacccgttcatgtgaatcaagttgcccaggatctgcaggaataatctgc

SEQ ID NO: 1053 - DNA, 200 bp, Ambrosia trifida
caacgtgacctttttgaagggattttacaggcgggatccacaattgttgagaatctgagaacgtataaacagccgttttcgtttacattccaaaaaccggtgaacttcgtggtggtgcatgggtggttgtggatagtcggatcaattcagaccatattgaaatgtatgcagaaaccactgccagaggaaatgttcttgaa

SEQ ID NO: 1054 - DNA, 200 bp, Ambrosia trifida
ttcaagaacatttcctctggcagtggtttctgcatacatttcaatatggtctgaattgatccgactatccacaaccacccatgcaccaccacgaagttcaccggtttttggaatgtaaacgaaaacggctgtttatacgttctcagattctcaacaattgtggatcccgcctgtaaaatcccttcaaaaaggtcacgttg

SEQ ID NO: 1055 - DNA, 200 bp, Ambrosia trifida
cactgccagaggaaatgttcttgaacccaaggaatgattgaaatcaaattccgaaataaagaattgttggactgcatgagccgactcgatccacaaatccaaattcttaaaggaaaacttaaagagtccaaatacgatcaaagaatcggcgaccagataaaagcccgtgagagacagcttttaccaatatacactcagat

SEQ ID NO: 1056 - DNA, 200 bp, Ambrosia trifida
atctgagtgtatattggtaaaagctgtctctcacgggcttttatctggtcgccgattctttgatcgtatttggactctttaagttttcctttaagaatttggatttgtggatcgagtcggctcatgcagtccaacaattctttatttcggaatttgatttcaatcattccttgggttcaagaacatttcctctggcagtg

SEQ ID NO: 1057 - DNA, 200 bp, Ambrosia trifida
agcttttaccaatatacactcagatcgccacgaaattcgctgagcttcatgacacatcgttccgaatggctgaaaaaggggtggtaaaagaagtggttgactggaaagcttctcggtttttcttctacaaaaggctgcggcgtaggctgggggaggcttctttgataagtagcatgcgtgatgctgcgggtgggacgctg

SEQ ID NO: 1058 - DNA, 200 bp, Ambrosia trifida
cagcgtcccacccgcagcatcacgcatgctacttatcaaagaagcctcccccagcctacgccgcagccttttgtagaagaaaaaccgagaagctttccagtcaaccacttcttttaccacccctttttcagccattcggaacgatgtgtcatgaagctcagcgaatttcgtggcgatctgagtgtatattggtaaaagct

SEQ ID NO: 1059 - DNA, 200 bp, Ambrosia trifida
gttgacctgaaacatgtttttgttttcaaaagttttagataatttgttagtcaaatatgatgaaatatacaaattattatttcaataataatccagtttttttaaaaagatataggtgatatgtgtacagtaaaaagatacaatttggtaggtatttcacaagttcaggcgctagaaacatgtccttttaagattttgtt

SEQ ID NO: 1060 - DNA, 200 bp, Ambrosia trifida
aacaaaatcttaaaaggacatgtttctagcgcctgaacttgtgaaatacctaccaaattgtatctttttactgtacacatatcacctatatctttttaaaaaaactggattattattgaaataataatttgtatatttcatcatatttgactaacaaattatctaaaacttttgaaaacaaaaacatgtttcaggtcaac

SEQ ID NO: 1061 - DNA, 200 bp, Ambrosia trifida
aaacatgtccttttaagattttgttctgccttgtaccttttgaacgtttaaagcagaacccgactcgacccattcatgagtaaatgggttgaaattgccgtctctagtttttctggttttatgtttccacttattaatattaaataaaatttattctgaagtcgatattttaaatttaacagggagttaggagtaaaaac

SEQ ID NO: 1062 - DNA, 200 bp, Ambrosia trifida
gtttttactcctaactccctgttaaatttaaaatatcgacttcagaataaattttatttaatattaataagtggaaacataaaaccagaaaaactagagacggcaatttcaacccatttactcatgaatgggtcgagtcgggttctgctttaaacgttcaaaaggtacaaggcagaacaaaatcttaaaaggacatgttt

SEQ ID NO: 1063 - DNA, 200 bp, Ambrosia trifida
ttaacagggagttaggagtaaaaacaagctgatactacgactgatggagcatttggtctaccctaatccagctccttatagagagaaactcatacggttttctgcactcaaccacacaagttattctgaggtcaatatcgtcatttaacatactcaaaggctctaactaactacttttttttattggcatatttaacttc

SEQ ID NO: 1064 - DNA, 200 bp, Ambrosia trifida
gaagttaaatatgccaataaaaaaaagtagttagttagagcctttgagtatgttaaatgacgatattgacctcagaataacttgtgtggttgagtgcagaaaaccgtatgagtttctctctataaggagctggattagggtagaccaaatgctccatcagtcgtagtatcagcttgtttttactcctaactccctgttaa

SEQ ID NO: 1065 - DNA, 200 bp, Ambrosia trifida
tttttttattggcatatttaacttcattatcattaatttaacagttagcattgaaggcaagtcaattgctggaacaaactaaattaagtgaacttcgttcaagtattgcaagaagtctatctgaattagaaatgtttaccgaagaaggtgagaatatcgatacccctaaaagaaaaagtgcaattaacgaaagaatggag

SEQ ID NO: 1066 - DNA, 200 bp, Ambrosia trifida
ctccattctttcgttaattgcactttttcttttaggggtatcgatattctcaccttcttcggtaaacatttctaattcagatagacttcttgcaatacttgaacgaagttcacttaatttagtttgttccagcaattgacttgccttcaatgctaactgttaaattaatgataatgaagttaaatatgccaataaaaaaa

SEQ ID NO: 1067 - DNA, 200 bp, Ambrosia trifida
aagtgcaattaacgaaagaatggaggatatcgtgagtgctcctttggcggttgaagatgcccttgttggtctttttgaccatagtgatcacacccttcaaaggcgtgttgttgagacctatgtcagaagattataccaggtatgcagttggtttttctcttaaacatatactatctatccatttaagtcgccattgacta

SEQ ID NO: 1068 - DNA, 200 bp, Ambrosia trifida
tagtcaatggcgacttaaatggatagatagtatatgtttaagagaaaaaccaactgcatacctggtataatcttctgacataggtctcaacaacacgcctttgaagggtgtgatcactatggtcaaaaagaccaacaagggcatcttcaaccgccaaaggagcactcacgatatcctccattctttcgttaattgcactt

SEQ ID NO: 1069 - DNA, 200 bp, Ambrosia trifida
tatccatttaagtcgccattgactaatacagctcaataaaaaaagttaaaaggatggatgtgattaatttgtaaatatcaaaatcaagtctattgtatattgatatttggtatgataaacaaggggcaaatgagtaattgtaccttgtaattctattttcagccatatcttgtgaaggggagtgttagaatgcaatggca

SEQ ID NO: 1070 - DNA, 200 bp, Ambrosia trifida
tgccattgcattctaacactccccttcacaagatatggctgaaaatagaattacaaggtacaattactcatttgccccttgtttatcataccaaatatcaatatacaatagacttgattttgatatttacaaattaatcacatccatccttttaactttttttattgagctgtattagtcaatggcgacttaaatggata

SEQ ID NO: 1071 - DNA, 200 bp, Ambrosia trifida
aggggagtgttagaatgcaatggcacagattgggacttattgcatcatggcaattcgtggaagggcatactgaggaattgaatgcttctggaccattggttgataggaaatggggagctatggttattattaaatctcttcaatttttgcccgatgtgataagtgcagctcttaaagaaacgactcaaactgggtcagca

SEQ ID NO: 1072 - DNA, 200 bp, Ambrosia trifida
tgctgacccagtttgagtcgtttctttaagagctgcacttatcacatcgggcaaaaattgaagagatttaataataaccatagctccccatttcctatcaaccaatggtccagaagcattcaattcctcagtatgcccttccacgaattgccatgatgcaataagtcccaatctgtgccattgcattctaacactcccct

SEQ ID NO: 1073 - DNA, 200 bp, Ambrosia trifida
agaaacgactcaaactgggtcagcaggtcatactattactaaccatggtaacatgatgcacattgcattggccggcatcaacaaccaaatgagtttgcttcaagacaggtttgaccatacaagtcaacatcatcatgtttggttataaatcaatttataaaaattcattatctctagaattgaaaccaaattatatttat

SEQ ID NO: 1074 - DNA, 200 bp, Ambrosia trifida
ataaatataatttggtttcaattctagagataatgaatttttataaattgatttataaccaaacatgatgatgttgacttgtatggtcaaacctgtcttgaagcaaactcatttggttgttgatgccggccaatgcaatgtgcatcatgttaccatggttagtaatagtatgacctgctgacccagtttgagtcgtttct

SEQ ID NO: 1075 - DNA, 200 bp, Ambrosia trifida
agaattgaaaccaaattatatttatatatttgatattaactaatacgcgcatattttcttataaactgcagtggtgatgaggaccaggcccaagaaagagtcaatcggttagcaaaaatattaaaggacaaagaactaagctcgagtctaaaaaacgcagggtatgatgttataagttgtataatacaaagagacgaagg

SEQ ID NO: 1076 - DNA, 200 bp, Ambrosia trifida
ccttcgtctctttgtattatacaacttataacatcataccctgcgttttttagactcgagcttagttctttgtcctttaatatttttgctaaccgattgactctttcttgggcctggtcctcatcaccactgcagtttataagaaaatatgcgcgtattagttaatatcaaatatataaatataatttggtttcaattct

SEQ ID NO: 1077 - DNA, 200 bp, Ambrosia trifida
gttgtataatacaaagagacgaaggtaggggcccaatgagacattcatttcattggtcagaaagtaatcgttattatgtcgaagagccattattgcgccatgtggaacctccattatctatttaccttgaactggtttgtactcatagcccgcttcattttgtttccatttctttaaatagtaataatactaaggacaaa

SEQ ID NO: 1078 - DNA, 200 bp, Ambrosia trifida
tttgtccttagtattattactatttaaagaaatggaaacaaaatgaagcgggctatgagtacaaaccagttcaaggtaaatagataatggaggttccacatggcgcaataatggctcttcgacataataacgattactttctgaccaatgaaatgaatgtctcattgggcccctaccttcgtctctttgtattatacaac

SEQ ID NO: 1079 - DNA, 200 bp, Ambrosia trifida
aaatagtaataatactaaggacaaatgtccacaaaaagtgaaatcgagtcagcttttagcacattaggcttccacgttatcgtttttacatgattggatgccatgtcagcagttttaagcattttgtatgccgtgtcaacttatgcaacctaactctttgcagtaacacacattaaagtgttgcaatagcgacacatttt

SEQ ID NO: 1080 - DNA, 200 bp, Ambrosia trifida
aaaatgtgtcgctattgcaacactttaatgtgtgttactgcaaagagttaggttgcataagttgacacggcatacaaaatgcttaaaactgctgacatggcatccaatcatgtaaaaacgataacgtggaagcctaatgtgctaaaagctgactcgatttcactttttgtggacatttgtccttagtattattactattt

SEQ ID NO: 1081 - DNA, 200 bp, Ambrosia trifida
aagtgttgcaatagcgacacattttagaagagaagtaaattttataaatactcataattttagaaggtttcggtaaaaaagtattagtttccagaaaggtctaaaattatttatgtcactatatatcttggcatttttatccacactcagtgaccagttttgttgtgttgctaaatttcaattttggtgcagcgaccctc

SEQ ID NO: 1082 - DNA, 200 bp, Ambrosia trifida
gagggtcgctgcaccaaaattgaaatttagcaacacaacaaaactggtcactgagtgtggataaaaatgccaagatatatagtgacataaataattttagacctttctggaaactaatacttttttaccgaaaccttctaaaattatgagtatttataaaatttacttctcttctaaaatgtgtcgctattgcaacactt

SEQ ID NO: 1083 - DNA, 200 bp, Ambrosia trifida
tttcaattttggtgcagcgaccctcttttaaagacttagtgaacaacggggacattcgattaccatttaatgacatattccctaatattagaagaaaagttatataaatttccatgtattataaattggttattttttcaggataaactgaagggctatgagaatatacagtacactccatcgcgcgacaaacaatggca

SEQ ID NO: 1084 - DNA, 200 bp, Ambrosia trifida
tgccattgtttgtcgcgcgatggagtgtactgtatattctcatagcccttcagtttatcctgaaaaaataaccaatttataatacatggaaatttatataacttttcttctaatattagggaatatgtcattaaatggtaatcgaatgtccccgttgttcactaagtctttaaaagagggtcgctgcaccaaaattgaaa

SEQ ID NO: 1085 - DNA, 200 bp, Ambrosia trifida
taatcctgaagattacagtcgaatcaaatcgtcagtgattgcacatgaattttgtctggagagtggtgaaaccagatggattattgatacaattgtaggaaaggaagacggattaggggttgagaatttaagcggtagcggggccattgctggtgcgttttcgaaagcatataaagaaacgttcaccttaacatatgtga

SEQ ID NO: 1086 - DNA, 200 bp, Ambrosia trifida
tcacatatgttaaggtgaacgtttctttatatgctttcgaaaacgcaccagcaatggccccgctaccgcttaaattctcaacccctaatccgtcttcctttcctacaattgtatcaataatccatctggtttcaccactctccagacaaaattcatgtgcaatcactgacgatttgattcgactgtaatcttcaggatta

SEQ ID NO: 1087 - DNA, 200 bp, Ambrosia trifida
gaaacgttcaccttaacatatgtgacgggaagaaccgttgggataggagcttatttggcccgtttgggaatgaggtgcatacaacggaccgaccaaccaataatcttgaccgggttttcggccctgaacaagcttttgggccgagaggtttacagctcgcaaatgcaacttggagggccgaagatcatggggacaaacgg

SEQ ID NO: 1088 - DNA, 200 bp, Ambrosia trifida
ccgtttgtccccatgatcttcggccctccaagttgcatttgcgagctgtaaacctctcggcccaaaagcttgttcagggccgaaaacccggtcaagattattggttggtcggtccgttgtatgcacctcattcccaaacgggccaaataagctcctatcccaacggttcttcccgtcacatatgttaaggtgaacgtttc

SEQ ID NO: 1089 - DNA, 200 bp, Ambrosia trifida
ggccgaagatcatggggacaaacggtgttgttcatttaacggtttctgacgatctggaaggcgttatggcaatcataaattggttgagctttgttccaccgtatgttggtggcccgcttcctgttttggcagcagtggacccggtagaccggcctgtggagtaccagcctgaaaactcgtgtgatcctcgtgcggctgtt

SEQ ID NO: 1090 - DNA, 200 bp, Ambrosia trifida
aacagccgcacgaggatcacacgagttttcaggctggtactccacaggccggtctaccgggtccactgctgccaaaacaggaagcgggccaccaacatacggtggaacaaagctcaaccaatttatgattgccataacgccttccagatcgtcagaaaccgttaaatgaacaacaccgtttgtccccatgatcttcggcc

SEQ ID NO: 1091 - DNA, 200 bp, Ambrosia trifida
ctcgtgtgatcctcgtgcggctgtttgtggtacagtggatgggaatgggaaatggttaggagggattttcgatagagacagttttgtggaaacattggagggttgggctaggacggttgtaacgggccgggccaaacttggtgggatccccgtaggggttattgctgtcgagacgcaaacagtgatgcaaataatacctg

SEQ ID NO: 1092 - DNA, 200 bp, Ambrosia trifida
caggtattatttgcatcactgtttgcgtctcgacagcaataacccctacggggatcccaccaagtttggcccggcccgttacaaccgtcctagcccaaccctccaatgtttccacaaaactgtctctatcgaaaatccctcctaaccatttcccattcccatccactgtaccacaaacagccgcacgaggatcacacgag

SEQ ID NO: 1093 - DNA, 200 bp, Ambrosia trifida
caaacagtgatgcaaataatacctgcggatcctgggcagctcgactcacacgaacgtgttgtcccgcaagctgggcaggtgtggttccctgattctgctagcaaaactgctcaagctttaatggattttaaccgcgaagagcttccgctgttcatcatggcgaactggcgggggttttctgctggtcaacgggatctttt

SEQ ID NO: 1094 - DNA, 200 bp, Ambrosia trifida
aaaagatcccgttgaccagcagaaaacccccgccagttcgccatgatgaacagcggaagctcttcgcggttaaaatccattaaagcttgagcagttttgctagcagaatcagggaaccacacctgcccagcttgcgggacaacacgttcgtgtgagtcgagctgcccaggatccgcaggtattatttgcatcactgtttg

SEQ ID NO: 1095 - DNA, 200 bp, Ambrosia trifida
tttctgctggtcaacgggatctttttgaaggaattttacaggcgggatcgacaattgttgagaaccttagaacgtataaacagccggttttcgtttacatcccgaaaaccggcgagcttcgtggcggcgcgtgggtggttgttgacagtcgaatcaactcggaccatatagaaatgtatgcagaaacaaccgcaaaagga

SEQ ID NO: 1096 - DNA, 200 bp, Ambrosia trifida
tccttttgcggttgtttctgcatacatttctatatggtccgagttgattcgactgtcaacaaccacccacgcgccgccacgaagctcgccggttttcgggatgtaaacgaaaaccggctgtttatacgttctaaggttctcaacaattgtcgatcccgcctgtaaaattccttcaaaaagatcccgttgaccagcagaaa

SEQ ID NO: 1097 - DNA, 200 bp, Ambrosia trifida
gtatgcagaaacaaccgcaaaaggaaatgttcttgaacccgaaggtatgattgaaattaagttccgaaacaaggaattgttagaatgtatgaaccgactggacccgcaaatccgaaacctcaaacaaaaattacaagaaacaaaatacgaccaaacaatcaccgaccagataaaagcccgtgagaagcaacttctgccca

SEQ ID NO: 1098 - DNA, 200 bp, Ambrosia trifida
tgggcagaagttgcttctcacgggcttttatctggtcggtgattgtttggtcgtattttgtttcttgtaatttttgtttgaggtttcggatttgcgggtccagtcggttcatacattctaacaattccttgtttcggaacttaatttcaatcataccttcgggttcaagaacatttccttttgcggttgtttctgcatac

SEQ ID NO: 1099 - DNA, 200 bp, Ambrosia trifida
gcccgtgagaagcaacttctgcccatttacactcagatcgccaccaagttcgcggagcttcacgacacatctttccgaatggctgaaaaaggcgtggtgaaaaaggttgttgactggaacatttctcggtttttcttctacaaaaggctccgccgtcggctcgcagaagcttctttaataaataccacacgtgatgccgc

SEQ ID NO: 1100 - DNA, 200 bp, Ambrosia trifida
gcggcatcacgtgtggtatttattaaagaagcttctgcgagccgacggcggagccttttgtagaagaaaaaccgagaaatgttccagtcaacaacctttttcaccacgcctttttcagccattcggaaagatgtgtcgtgaagctccgcgaacttggtggcgatctgagtgtaaatgggcagaagttgcttctcacgggc

SEQ ID NO: 1101 - DNA, 200 bp, Ambrosia trifida
taataaataccacacgtgatgccgccggtgacacacttacctacaatgctgcttatgatatgatcaagaaatggtttttggccacgaagacggaagaagtttggcttgatgatgatgtgtttttcacatggaaagatgacccgtctaattacaccgataagttagccacattacgtacacagaaggtttcgaatcagcta

SEQ ID NO: 1102 - DNA, 200 bp, Ambrosia trifida
tagctgattcgaaaccttctgtgtacgtaatgtggctaacttatcggtgtaattagacgggtcatctttccatgtgaaaaacacatcatcatcaagccaaacttcttccgtcttcgtggccaaaaaccatttcttgatcatatcataagcagcattgtaggtaagtgtgtcaccggcggcatcacgtgtggtatttatta

SEQ ID NO: 1103 - DNA, 200 bp, Ambrosia trifida
tacacagaaggtttcgaatcagctattaaagtttggtggttcaccgtctgatctggaagctttaccgcaggggcttgctgcacttctgcaagaggtggatccagcgactaaaagtaaactaattgaagacatccggcgtgtcattgagacttggccggctaaatgagaagccattcgggcaatgtatactatttagaact

SEQ ID NO: 1104 - DNA, 200 bp, Ambrosia trifida
agttctaaatagtatacattgcccgaatggcttctcatttagccggccaagtctcaatgacacgccggatgtcttcaattagtttacttttagtcgctggatccacctcttgcagaagtgcagcaagcccctgcggtaaagcttccagatcagacggtgaaccaccaaactttaatagctgattcgaaaccttctgtgta

SEQ ID NO: 1105 - DNA, 200 bp, Ambrosia trifida
tggcggccgtaaagtttataagaagtgtgagaacatggagttatgaaacatttggttcagaaaaagcaattttgttggtagccatggcgactccggaggatatgaggataaatgcagagcatattagaattgctgatcaatttgtggaagtcccaggtggtacaaataataataattatgcaaacgtgcaactcattgtg

SEQ ID NO: 1106 - DNA, 200 bp, Ambrosia trifida
cacaatgagttgcacgtttgcataattattattatttgtaccacctgggacttccacaaattgatcagcaattctaatatgctctgcatttatcctcatatcctccggagtcgccatggctaccaacaaaattgctttttctgaaccaaatgtttcataactccatgttctcacacttcttataaactttacggccgcca

SEQ ID NO: 1107 - DNA, 200 bp, Ambrosia trifida
ttatgcaaacgtgcaactcattgtggaggtatataggtttcatacatatataatttatttaggcatcaactgatgtattttatgaaccaccatacacgccattttattgcaaagtaaccattgttctttagaacagtcttattttgacttttcggtcaaattatctgtttataaacgttcattcctgcaacgataagtca

SEQ ID NO: 1108 - DNA, 200 bp, Ambrosia trifida
tgacttatcgttgcaggaatgaacgtttataaacagataatttgaccgaaaagtcaaaataagactgttctaaagaacaatggttactttgcaataaaatggcgtgtatggtggttcataaaatacatcagttgatgcctaaataaattatatatgtatgaaacctatatacctccacaatgagttgcacgtttgcataa

SEQ ID NO: 1109 - DNA, 200 bp, Ambrosia trifida
cgttcattcctgcaacgataagtcagatatgatggttcaagaagtcggtcactaaacaagggttggatttaccttcacttattcagaagtccttaaaatattacatttgctctctacaaagtattttttactatgaattttcaagtggactacatcaattttgtaattaatacgaaattacaaatgtgtgtaacttttga

SEQ ID NO: 1110 - DNA, 200 bp, Ambrosia trifida
tcaaaagttacacacatttgtaatttcgtattaattacaaaattgatgtagtccacttgaaaattcatagtaaaaaatactttgtagagagcaaatgtaatattttaaggacttctgaataagtgaaggtaaatccaacccttgtttagtgaccgacttcttgaaccatcatatctgacttatcgttgcaggaatgaacg

SEQ ID NO: 1111 - DNA, 200 bp, Ambrosia trifida
aattacaaatgtgtgtaacttttgatgaaaaatcctactttgacatacctaactatatccttaagttataacattgatattgcaatgcttaacttttgaggaaaatcattacctacatcatgtttaatgattgcagactgctgagataacacatgttgatgctgtttggcctggttggggtcatgcatctgaaatcccgg

SEQ ID NO: 1112 - DNA, 200 bp, Ambrosia trifida
ccgggatttcagatgcatgaccccaaccaggccaaacagcatcaacatgtgttatctcagcagtctgcaatcattaaacatgatgtaggtaatgattttcctcaaaagttaagcattgcaatatcaatgttataacttaaggatatagttaggtatgtcaaagtaggatttttcatcaaaagttacacacatttgtaatt

SEQ ID NO: 1113 - DNA, 200 bp, Ambrosia trifida
tggggtcatgcatctgaaatcccggaactaccagatgcattggaggctaaaggaattatatttcttgggccacctgctgcttccatggcagctttaggagataaaatcggttcatcgttgattgcactagcagctgatgtgccaacacttccatggagtggctctcatgtaagttttgccacttttatagtcagtccttt

SEQ ID NO: 1114 - DNA, 200 bp, Ambrosia trifida
aaaggactgactataaaagtggcaaaacttacatgagagccactccatggaagtgttggcacatcagctgctagtgcaatcaacgatgaaccgattttatctcctaaagctgccatggaagcagcaggtggcccaagaaatataattcctttagcctccaatgcatctggtagttccgggatttcagatgcatgacccca

SEQ ID NO: 1115 - DNA, 200 bp, Ambrosia trifida
ttgccacttttatagtcagtcctttttagttttttcagaaaaaaaaaactcatttcatacctcttgtttttcaaaaaactggttcctaatgctacttattttttaaaaactgcatctttactagtctttataacacctcatctttttagctcgtattcttttacaattgcacctataaacctcaaaaatctcatctttat

SEQ ID NO: 1116 - DNA, 200 bp, Ambrosia trifida
ataaagatgagatttttgaggtttataggtgcaattgtaaaagaatacgagctaaaaagatgaggtgttataaagactagtaaagatgcagtttttaaaaaataagtagcattaggaaccagttttttgaaaaacaagaggtatgaaatgagttttttttttctgaaaaaactaaaaaggactgactataaaagtggcaa

SEQ ID NO: 1117 - DNA, 200 bp, Ambrosia trifida
taaacctcaaaaatctcatctttattctgcttattatataaaatatcctgctttaggtgaaaattcctgtggaaagctgtttggccacaatcccagatgatgtatatagaaaagcttgtgtatctacaactgaagaagcaattgctagctgtcagtttattggttatccggctatgatcaaggcatcatggggcggaggt

SEQ ID NO: 1118 - DNA, 200 bp, Ambrosia trifida
acctccgccccatgatgccttgatcatagccggataaccaataaactgacagctagcaattgcttcttcagttgtagatacacaagcttttctatatacatcatctgggattgtggccaaacagctttccacaggaattttcacctaaagcaggatattttatataataagcagaataaagatgagatttttgaggttta

SEQ ID NO: 1119 - DNA, 200 bp, Ambrosia trifida
gatcaaggcatcatggggcggaggtggcaaaggcataagaaaggtttgtttccttcaacttgacctttaaaagtcaataaactagttttgacctcaaagcacttatttatttttgttaatttaggtgcataatgatgaagaagtcaaggcacttttcaagcaagttcaaggtgaagtgccaggttcacctatattcatta

SEQ ID NO: 1120 - DNA, 200 bp, Ambrosia trifida
taatgaatataggtgaacctggcacttcaccttgaacttgcttgaaaagtgccttgacttcttcatcattatgcacctaaattaacaaaaataaataagtgctttgaggtcaaaactagtttattgacttttaaaggtcaagttgaaggaaacaaacctttcttatgcctttgccacctccgccccatgatgccttgatc

SEQ ID NO: 1121 - DNA, 200 bp, Ambrosia trifida
gtgccaggttcacctatattcattatgaaagttgcctcccaggtgagaaaacgtttgaataactcatctgatcttaatgtgtgacttaaaacttattataacactatttaaatattattttaaaaccagagccggcatctagaagttcagctactgtgtgatcagcatggcaatgtagcagccttacatagtcgtgattg

SEQ ID NO: 1122 - DNA, 200 bp, Ambrosia trifida
caatcacgactatgtaaggctgctacattgccatgctgatcacacagtagctgaacttctagatgccggctctggttttaaaataatatttaaatagtgttataataagttttaagtcacacattaagatcagatgagttattcaaacgttttctcacctgggaggcaactttcataatgaatataggtgaacctggcac

SEQ ID NO: 1123 - DNA, 200 bp, Ambrosia trifida
acaatggaatggctgctgttaagtttataacaagtgtcagaacatggagctacgaaacatttggttcagaaaaagctatttcattggtcgccatggctactccagaagatatgaggataaatgcagagcatattagaatcgctgatcagtttgttgaagtccctggtggtacaaataataataattatgctaatgtgcaa

SEQ ID NO: 1124 - DNA, 200 bp, Ambrosia trifida
ttgcacattagcataattattattatttgtaccaccagggacttcaacaaactgatcagcgattctaatatgctctgcatttatcctcatatcttctggagtagccatggcgaccaatgaaatagctttttctgaaccaaatgtttcgtagctccatgttctgacacttgttataaacttaacagcagccattccattgt

SEQ ID NO: 1125 - DNA, 200 bp, Ambrosia trifida
ttttcaaaaaaaaaaaattaaaaaaaaaaatagtgtctacttcttttttgtattaaatttatttgcacataactcttttataaagcaagtcatgtttgtacattttaacttcaaagactcatgacacgaaaataaaacgaataagttaaatttgtttacataatattgtgctacatttacatatatacttgttatccaat

SEQ ID NO: 1126 - DNA, 200 bp, Ambrosia trifida
attggataacaagtatatatgtaaatgtagcacaatattatgtaaacaaatttaacttattcgttttattttcgtgtcatgagtctttgaagttaaaatgtacaaacatgacttgctttataaaagagttatgtgcaaataaatttaatacaaaaaagaagtagacactatttttttttttaattttttttttttgaaaa

SEQ ID NO: 1127 - DNA, 200 bp, Ambrosia trifida
tttacatatatacttgttatccaatagttaattatgatgatttacatttttaattatttgtgttcaaagtttgtttaaactcactggataatcttgggagttaaggcaagtatggcattgaaaagtagaaccctgggccctgaaacagcgattgaaaaaaagcagtggcgatgggtcgaactggtcaattcaaagggtcc

SEQ ID NO: 1128 - DNA, 200 bp, Ambrosia trifida
ggaccctttgaattgaccagttcgacccatcgccactgctttttttcaatcgctgtttcagggcccagggttctacttttcaatgccatacttgccttaactcccaagattatccagtgagtttaaacaaactttgaacacaaataattaaaaatgtaaatcatcataattaactattggataacaagtatatatgtaaa

SEQ ID NO: 1129 - DNA, 200 bp, Ambrosia trifida
tcgaactggtcaattcaaagggtccctttatcagcaaattacttggacaattttgacttttactttgacctcttccaataatatagcttttttttattccttctaattttaactacaaatatacatgtttgtttttctacacactttcaacatctgtacatttctatcagtttgtctacagtatataatcgcaagaatat

SEQ ID NO: 1130 - DNA, 200 bp, Ambrosia trifida
atattcttgcgattatatactgtagacaaactgatagaaatgtacagatgttgaaagtgtgtagaaaaacaaacatgtatatttgtagttaaaattagaaggaataaaaaaaagctatattattggaagaggtcaaagtaaaagtcaaaattgtccaagtaatttgctgataaagggaccctttgaattgaccagttcga

SEQ ID NO: 1131 - DNA, 200 bp, Ambrosia trifida
ctacagtatataatcgcaagaatatttcgacttataatcatagatattctgtttgcacttatagcatgcaaaatacagatgcatagaatttgcatacgcctaaaagtgcagagaaaaatcatgtgaacattcttatgtccgttttataaatgttgctcacaaatagacaaaaatattactgtttttttgttatactatgt

SEQ ID NO: 1132 - DNA, 200 bp, Ambrosia trifida
acatagtataacaaaaaaacagtaatatttttgtctatttgtgagcaacatttataaaacggacataagaatgttcacatgatttttctctgcacttttaggcgtatgcaaattctatgcatctgtattttgcatgctataagtgcaaacagaatatctatgattataagtcgaaatattcttgcgattatatactgtag

SEQ ID NO: 1133 - DNA, 200 bp, Ambrosia trifida
ttactgtttttttgttatactatgtagaaaaagtcatgcaaatcacatacatatggattgttttataacaattacaaattgtgtgcaggagagttgacgtagattctgggaccgaagagggtgtggttgaggcacttttggtgaagttggctcgtgagatacacacaatggttggtataaaaatgcaccggttaggtgtt

SEQ ID NO: 1134 - DNA, 200 bp, Ambrosia trifida
aacacctaaccggtgcatttttataccaaccattgtgtgtatctcacgagccaacttcaccaaaagtgcctcaaccacaccctcttcggtcccagaatctacgtcaactctcctgcacacaatttgtaattgttataaaacaatccatatgtatgtgatttgcatgactttttctacatagtataacaaaaaaacagtaa

SEQ ID NO: 1135 - DNA, 200 bp, Ambrosia trifida
tataaaaatgcaccggttaggtgtttttgagtgggaggttaagcttcgcatggtgtcttctggtcaagccaatggtgcctggagggtggtggtcactaatgtgaccggtcatacgtgtattgtacatgtaagttaaaaggccattttagacatttcaacaataggtaaactctttttgctcatacatgcttaatgttact

SEQ ID NO: 1136 - DNA, 200 bp, Ambrosia trifida
agtaacattaagcatgtatgagcaaaaagagtttacctattgttgaaatgtctaaaatggccttttaacttacatgtacaatacacgtatgaccggtcacattagtgaccaccaccctccaggcaccattggcttgaccagaagacaccatgcgaagcttaacctcccactcaaaaacacctaaccggtgcatttttata

SEQ ID NO: 1137 - DNA, 200 bp, Ambrosia trifida
ttgctcatacatgcttaatgttactctttgcgattttcatttaggtctatcgggaaatcgaggataatgttgaacacaaggtagtttatcatgctacctcgacatcaagccccttacatggtgtatctgtgaacacaccatttcagcctttgaaattactcgatcagaaacgtcttttggcccgtaaaagcaatactact

SEQ ID NO: 1138 - DNA, 200 bp, Ambrosia trifida
agtagtattgcttttacgggccaaaagacgtttctgatcgagtaatttcaaaggctgaaatggtgtgttcacagatacaccatgtaaggggcttgatgtcgaggtagcatgataaactaccttgtgttcaacattatcctcgatttcccgatagacctaaatgaaaatcgcaaagagtaacattaagcatgtatgagcaa

SEQ ID NO: 1139 - DNA, 200 bp, Ambrosia trifida
tttggcccgtaaaagcaatactacttactgctatgactttgcactggtaaaattgccattttgcccttctacttttaatgcatgcatgttcttttatttaaaagtagtaaaattaccattctgccctttcgaacttggattatggttaattcttacggatcttgcttttgtatccgcaggcatttgaagcagcccttgag

SEQ ID NO: 1140 - DNA, 200 bp, Ambrosia trifida
ctcaagggctgcttcaaatgcctgcggatacaaaagcaagatccgtaagaattaaccataatccaagttcgaaagggcagaatggtaattttactacttttaaataaaagaacatgcatgcattaaaagtagaagggcaaaatggcaattttaccagtgcaaagtcatagcagtaagtagtattgcttttacgggccaaa

SEQ ID NO: 1141 - DNA, 200 bp, Ambrosia trifida
gcaggcatttgaagcagcccttgagaatatctggtcattgaaactcccaggtgtcaacaagcccgttggtaagcttgtaaatgtgacagagctcgcatttgctgacccgagaggctcatggggtacaccgcttgtgcaaataaaccgtgagccgggccagaacaatgcgggcatggtggcttggaccatggacctctgca

SEQ ID NO: 1142 - DNA, 200 bp, Ambrosia trifida
tgcagaggtccatggtccaagccaccatgcccgcattgttctggcccggctcacggtttatttgcacaagcggtgtaccccatgagcctctcgggtcagcaaatgcgagctctgtcacatttacaagcttaccaacgggcttgttgacacctgggagtttcaatgaccagatattctcaagggctgcttcaaatgcctgc

SEQ ID NO: 1143 - DNA, 200 bp, Ambrosia trifida
gtggcttggaccatggacctctgcacacctgagtttcctcatggaaggacaattttggtagttgcaaacgatgtcacgtttaaaaatgggtctttcggcccgattgaggacgcgtttttcgaggcggtcaccgaacttgcctgttccaagaaactgccactcatttacctggcagcgaactcgggggcccgaattggggc

SEQ ID NO: 1144 - DNA, 200 bp, Ambrosia trifida
gccccaattcgggcccccgagttcgctgccaggtaaatgagtggcagtttcttggaacaggcaagttcggtgaccgcctcgaaaaacgcgtcctcaatcgggccgaaagacccatttttaaacgtgacatcgtttgcaactaccaaaattgtccttccatgaggaaactcaggtgtgcagaggtccatggtccaagccac

SEQ ID NO: 1145 - DNA, 200 bp, Ambrosia trifida
cgaactcgggggcccgaattggggcggctgaggaggttagatcttgctttagaattgggtggtccgatgaatcgaaccctgattcagggttccagtatttgtacctaactcctgaagattacagtcgaatcaaatcgtcagtgattgcacatgaattttgtttggagagtggtgaaaccagatggattattgatacaatt

SEQ ID NO: 1146 - DNA, 200 bp, Ambrosia trifida
aattgtatcaataatccatctggtttcaccactctccaaacaaaattcatgtgcaatcactgacgatttgattcgactgtaatcttcaggagttaggtacaaatactggaaccctgaatcagggttcgattcatcggaccacccaattctaaagcaagatctaacctcctcagccgccccaattcgggcccccgagttcg

SEQ ID NO: 1147 - DNA, 200 bp, Ambrosia trifida
aaccagatggattattgatacaattgtaggaaaggaagacggattaggggttgagaatttaagcggtagcggggccattgctggtgcgttttcgaaagcatataaagaaacgttcaccttaacatatgtgacgggaagaaccgttgggataggagcttatttggcccgtttgggaatgaggtgcatacaacggaccgacc

SEQ ID NO: 1148 - DNA, 200 bp, Ambrosia trifida
ggtcggtccgttgtatgcacctcattcccaaacgggccaaataagctcctatcccaacggttcttcccgtcacatatgttaaggtgaacgtttctttatatgctttcgaaaacgcaccagcaatggccccgctaccgcttaaattctcaacccctaatccgtcttcctttcctacaattgtatcaataatccatctggtt

SEQ ID NO: 1149 - DNA, 200 bp, Ambrosia trifida
atgaggtgcatacaacggaccgaccaaccaataatcttgaccgggttttcggccctgaacaagcttttgggccgagaggtttacagctcgcaaatgcaacttggagggccgaagatcatggggacaaacggtgttgttcatttaacggtttctgacgatctggaaggcgttatggcaatcataaattggttgagctttgt

SEQ ID NO: 1150 - DNA, 200 bp, Ambrosia trifida
acaaagctcaaccaatttatgattgccataacgccttccagatcgtcagaaaccgttaaatgaacaacaccgtttgtccccatgatcttcggccctccaagttgcatttgcgagctgtaaacctctcggcccaaaagcttgttcagggccgaaaacccggtcaagattattggttggtcggtccgttgtatgcacctcat

SEQ ID NO: 1151 - DNA, 200 bp, Ambrosia trifida
caatcataaattggttgagctttgttccaccgtatgttggtggcccgcttcctgttttggcagcagtggacccggtagaccggcctgtggagtaccagcctgaaaactcgtgtgatcctcgtgcggctgtttgtggtacagtggatgggaatgggaaatggttaggagggattttcgatagagacagttttgtggaaaca

SEQ ID NO: 1152 - DNA, 200 bp, Ambrosia trifida
tgtttccacaaaactgtctctatcgaaaatccctcctaaccatttcccattcccatccactgtaccacaaacagccgcacgaggatcacacgagttttcaggctggtactccacaggccggtctaccgggtccactgctgccaaaacaggaagcgggccaccaacatacggtggaacaaagctcaaccaatttatgattg

SEQ ID NO: 1153 - DNA, 200 bp, Ambrosia trifida
cgatagagacagttttgtggaaacattggagggttgggctaggacggttgtaacgggccgggccaaacttggtgggatccccgtaggggttattgctgtcgagacgcaaacagtgatgcaaataatacctgcggatcctgggcagctcgactcacacgaacgtgttgtcccgcaagctgggcaggtgtggttccctgatt

SEQ ID NO: 1154 - DNA, 200 bp, Ambrosia trifida
aatcagggaaccacacctgcccagcttgcgggacaacacgttcgtgtgagtcgagctgcccaggatccgcaggtattatttgcatcactgtttgcgtctcgacagcaataacccctacggggatcccaccaagtttggcccggcccgttacaaccgtcctagcccaaccctccaatgtttccacaaaactgtctctatcg

SEQ ID NO: 1155 - DNA, 200 bp, Ambrosia trifida
gctgggcaggtgtggttccctgattctgctagcaaaactgctcaagctttaatggattttaaccgcgaagagcttccgctgttcatcatggcgaactggcgggggttttctgctggtcaacgggatctttttgaaggaattttacaggcgggatcgacaattgttgagaaccttagaacgtataaacagccggttttcgt

SEQ ID NO: 1156 - DNA, 200 bp, Ambrosia trifida
acgaaaaccggctgtttatacgttctaaggttctcaacaattgtcgatcccgcctgtaaaattccttcaaaaagatcccgttgaccagcagaaaacccccgccagttcgccatgatgaacagcggaagctcttcgcggttaaaatccattaaagcttgagcagttttgctagcagaatcagggaaccacacctgcccagc

SEQ ID NO: 1157 - DNA, 200 bp, Ambrosia trifida
gaacgtataaacagccggttttcgtttacatcccgaaaaccggcgagcttcgtggcggcgcgtgggtggttgttgacagtcgaatcaactcggaccatatagaaatgtatgcagaaacaaccgcaaaaggaaatgttcttgaacctgaaggtatgattgaaattaagttccgaaacaaagaattgttagaatgtatgaac

SEQ ID NO: 1158 - DNA, 200 bp, Ambrosia trifida
gttcatacattctaacaattctttgtttcggaacttaatttcaatcataccttcaggttcaagaacatttccttttgcggttgtttctgcatacatttctatatggtccgagttgattcgactgtcaacaaccacccacgcgccgccacgaagctcgccggttttcgggatgtaaacgaaaaccggctgtttatacgttc

SEQ ID NO: 1159 - DNA, 200 bp, Ambrosia trifida
caaagaattgttagaatgtatgaaccgactggacccgcaaatccgaaacctcaaacaaaaattacaagaaacaaaatacgaccaaacaatcaccgaccagataaaagcccgtgagaagcaacttctgcccatttacactcagatcgccaccaagttcgcggagcttcacgacacatctttccgaatggctgaaaaagggg

SEQ ID NO: 1160 - DNA, 200 bp, Ambrosia trifida
cccctttttcagccattcggaaagatgtgtcgtgaagctccgcgaacttggtggcgatctgagtgtaaatgggcagaagttgcttctcacgggcttttatctggtcggtgattgtttggtcgtattttgtttcttgtaatttttgtttgaggtttcggatttgcgggtccagtcggttcatacattctaacaattctttg

SEQ ID NO: 1161 - DNA, 200 bp, Ambrosia trifida
tctttccgaatggctgaaaaaggggtggtaaaagaagaagtggtggttgactggaaagcttcttctcggtttttcttctacaaaaggctgcggcgtaggctgggggaggcttctttgataagtagcatgcgtgatgctgctggtgacacgcttacctacaatgctgcttatgatatgatcaagaaatggtttttggagag

SEQ ID NO: 1162 - DNA, 200 bp, Ambrosia trifida
ctctccaaaaaccatttcttgatcatatcataagcagcattgtaggtaagcgtgtcaccagcagcatcacgcatgctacttatcaaagaagcctcccccagcctacgccgcagccttttgtagaagaaaaaccgagaagaagctttccagtcaaccaccacttcttcttttaccacccctttttcagccattcggaaaga

SEQ ID NO: 1163 - DNA, 200 bp, Ambrosia trifida
tgatcaagaaatggtttttggagagcaaaggggaagcagagttgtgggttgatgatgatgcttttttcacatggaaagatgacccgtctaattacactgataagttagccacattacgtacacagaagatatcaaatcagttattaaagattggtggttcaccgtccgatctggaagctttaccgcaggggcttgctgca

SEQ ID NO: 1164 - DNA, 200 bp, Ambrosia trifida
tgcagcaagcccctgcggtaaagcttccagatcggacggtgaaccaccaatctttaataactgatttgatatcttctgtgtacgtaatgtggctaacttatcagtgtaattagacgggtcatctttccatgtgaaaaaagcatcatcatcaacccacaactctgcttcccctttgctctccaaaaaccatttcttgatca

SEQ ID NO: 1165 - DNA, 200 bp, Ambrosia trifida
agctttaccgcaggggcttgctgcacttctgcaagaggtaactgttgtttcttgaatcttgacgactacattcctttcaccattttgcaagtcgagaataagattgtttttaatgtcgttttgtttgttgtgtttcaggtggatccagcgactaaaagtaaactaattgaagacatccggcgtgtcattgagacttggcc

SEQ ID NO: 1166 - DNA, 200 bp, Ambrosia trifida
ggccaagtctcaatgacacgccggatgtcttcaattagtttacttttagtcgctggatccacctgaaacacaacaaacaaaacgacattaaaaacaatcttattctcgacttgcaaaatggtgaaaggaatgtagtcgtcaagattcaagaaacaacagttacctcttgcagaagtgcagcaagcccctgcggtaaagct

SEQ ID NO: 1167 - DNA, 200 bp, Ambrosia trifida
tccggcgtgtcattgagacttggccggctaaatgagaagccattcgggcaatgtatactatttagaactactacatgtaagaatatttattttccttgaatatttttgtaaataaatcacacatttcgaatcatatcaaataattattcattgtagtcttttctgtaatcggtatttgcgatatctatgtttgagtattt

SEQ ID NO: 1168 - DNA, 200 bp, Ambrosia trifida
aaatactcaaacatagatatcgcaaataccgattacagaaaagactacaatgaataattatttgatatgattcgaaatgtgtgatttatttacaaaaatattcaaggaaaataaatattcttacatgtagtagttctaaatagtatacattgcccgaatggcttctcatttagccggccaagtctcaatgacacgccgga

SEQ ID NO: 1169 - DNA, 200 bp, Ambrosia trifida
ttgcgatatctatgtttgagtatttattaactaattatacaaatctttgttgggctttgcactttctggatcaacaactcagacctcgtgatcaagctttggtgaacatgaatgaactgcatctgcaacagtgagaaaaatcttgttttccccaatcaagtcggggaaacctgatgcgtatagcttgtctagcacttgtt

SEQ ID NO: 1170 - DNA, 200 bp, Ambrosia trifida
aacaagtgctagacaagctatacgcatcaggtttccccgacttgattggggaaaacaagatttttctcactgttgcagatgcagttcattcatgttcaccaaagcttgatcacgaggtctgagttgttgatccagaaagtgcaaagcccaacaaagatttgtataattagttaataaatactcaaacatagatatcgcaa

SEQ ID NO: 1171 - DNA, 200 bp, Ambrosia trifida
gcgtatagcttgtctagcacttgttgacccgggttcgcaagaataagctgtcaaaccaaaatattattgttttagcacgcaattgcggaaattattatgaaaactttttatccgttgttaaccgtataataaatgagttgatgatatgtgtagtagtgtttaatcgcataaaattacatgttttgttctcaactggtttt

SEQ ID NO: 1172 - DNA, 200 bp, Ambrosia trifida
aaaaccagttgagaacaaaacatgtaattttatgcgattaaacactactacacatatcatcaactcatttattatacggttaacaacggataaaaagttttcataataatttccgcaattgcgtgctaaaacaataatattttggtttgacagcttattcttgcgaacccgggtcaacaagtgctagacaagctatacgc

SEQ ID NO: 1173 - DNA, 200 bp, Ambrosia trifida
acatgttttgttctcaactggttttggcacgtttacttgtaatattataaacagtattgctgctgcttacttggacatctctcttttgcagactacggtataactcttccaaggcatggattccacttgtgtcgatatcagtaaccgctgcagttagagaacactctttaaacaaagtattcgccccgctcattaaatat

SEQ ID NO: 1174 - DNA, 200 bp, Ambrosia trifida
atatttaatgagcggggcgaatactttgtttaaagagtgttctctaactgcagcggttactgatatcgacacaagtggaatccatgccttggaagagttataccgtagtctgcaaaagagagatgtccaagtaagcagcagcaatactgtttataatattacaagtaaacgtgccaaaaccagttgagaacaaaacatgt

SEQ ID NO: 1175 - DNA, 200 bp, Ambrosia trifida
agtattcgccccgctcattaaatattcatgactgactataggaaatagaagagcttctttcttacgtgacaattccactatcaagaactgaattttgggttgaaaagttgctgcttttagattatcttcttcctcagctagccatcttaatatcctgcaacgaattatagctttcaaggatggaaacatacatacataca

SEQ ID NO: 1176 - DNA, 200 bp, Ambrosia trifida
tgtatgtatgtatgtttccatccttgaaagctataattcgttgcaggatattaagatggctagctgaggaagaagataatctaaaagcagcaacttttcaacccaaaattcagttcttgatagtggaattgtcacgtaagaaagaagctcttctatttcctatagtcagtcatgaatatttaatgagcggggcgaatact

SEQ ID NO: 1177 - DNA, 200 bp, Commelina diffusa
aaaaaaaaaaaaaaacaaagatcttatgatagtctgaaaacaaactttgaccagtgtgattttatgttaagtgtatttacctatctttcaattgacttttcaggttcacaatgacgatgaagtgagagctctcttcaaacaagtgcaaggagaagttccaggatctccaatatttataatgaaagtggcatcacaggtga

SEQ ID NO: 1178 - DNA, 200 bp, Commelina diffusa
tcacctgtgatgccactttcattataaatattggagatcctggaacttctccttgcacttgtttgaagagagctctcacttcatcgtcattgtgaacctgaaaagtcaattgaaagataggtaaatacacttaacataaaatcacactggtcaaagtttgttttcagactatcataagatctttgttttttttttttttt

SEQ ID NO: 1179 - DNA, 200 bp, Commelina diffusa
ataatgaaagtggcatcacaggtgagataaatgtatttttaaagcttcagttatgtcatgaatttatatggccctgcattaactgaatctagactatgcccaatatgaaattattgcaggttactttaagcagaatatatgtttgacagtaagtaggctgacttagtactgaacaattgagtgtatcaatgcatgcccaa

SEQ ID NO: 1180 - DNA, 200 bp, Commelina diffusa
ttgggcatgcattgatacactcaattgttcagtactaagtcagcctacttactgtcaaacatatattctgcttaaagtaacctgcaataatttcatattgggcatagtctagattcagttaatgcagggccatataaattcatgacataactgaagctttaaaaatacatttatctcacctgtgatgccactttcattat

SEQ ID NO: 1181 - DNA, 200 bp, Commelina diffusa
attgagtgtatcaatgcatgcccaatataatagtgtgtttcatttcaggataaaaagtgagatgtagttttcggattcaacatatgcattctttttcaaccttgatgtcatcagtcaatgcatagtagtgcatgtacttgactttgtgtatgtaattattattctttggtagttgcaattaaaggatgcattgatacacc

SEQ ID NO: 1182 - DNA, 200 bp, Commelina diffusa
ggtgtatcaatgcatcctttaattgcaactaccaaagaataataattacatacacaaagtcaagtacatgcactactatgcattgactgatgacatcaaggttgaaaaagaatgcatatgttgaatccgaaaactacatctcactttttatcctgaaatgaaacacactattatattgggcatgcattgatacactcaat

SEQ ID NO: 1183 - DNA, 200 bp, Commelina diffusa
caattaaaggatgcattgatacacccaattgtatcatcagttattttgcaattcatattccacccttctgtttttaggaaattctagaaacttttaacttggaagctctagaataccatatcttgctttatatcatggcagttacactgaagctttatgttacatgtgcattcatttttaacgctccaatattgttatcc

SEQ ID NO: 1184 - DNA, 200 bp, Commelina diffusa
ggataacaatattggagcgttaaaaatgaatgcacatgtaacataaagcttcagtgtaactgccatgatataaagcaagatatggtattctagagcttccaagttaaaagtttctagaatttcctaaaaacagaagggtggaatatgaattgcaaaataactgatgatacaattgggtgtatcaatgcatcctttaattg

SEQ ID NO: 1185 - DNA, 200 bp, Commelina diffusa
ttttaacgctccaatattgttatccttttatttcctctagagtcgtcacttggaagttcagttgctttgtgatgaatatggcaatgttgctgctcttcacagtcgagattgcagtgttcaaaggcgacaccaaaaggtaaactttagtaaagcatctatataattatgttatttgtaacctttcatgcttacctttatat

SEQ ID NO: 1186 - DNA, 200 bp, Commelina diffusa
atataaaggtaagcatgaaaggttacaaataacataattatatagatgctttactaaagtttaccttttggtgtcgcctttgaacactgcaatctcgactgtgaagagcagcaacattgccatattcatcacaaagcaactgaacttccaagtgacgactctagaggaaataaaaggataacaatattggagcgttaaaa

SEQ ID NO: 1187 - DNA, 200 bp, Commelina diffusa
taacctttcatgcttacctttatatttcatagacctgaaccatgtctatgaatatatttgtgtgctgttatgagcaggttatttttctccagatcatgtatctttatcctgaactcttgtggacttatcttgaattaacattttgtaaatatttcaagactttcttcatgatgcttatttattacccaacagatcatcga

SEQ ID NO: 1188 - DNA, 200 bp, Commelina diffusa
tcgatgatctgttgggtaataaataagcatcatgaagaaagtcttgaaatatttacaaaatgttaattcaagataagtccacaagagttcaggataaagatacatgatctggagaaaaataacctgctcataacagcacacaaatatattcatagacatggttcaggtctatgaaatataaaggtaagcatgaaaggtta

SEQ ID NO: 1189 - DNA, 200 bp, Commelina diffusa
tatttattacccaacagatcatcgaagaaggtccgatcacggtggcccctcctgagacagtcaaacaacttgagcaggcagcaagaaggcttgctaagtgtgttggttatgttggtgctgctactgttgaatatctctacagtatggaaactggtgactactatttcctagaactgaaccctcgattacaggtttgtctt

SEQ ID NO: 1190 - DNA, 200 bp, Commelina diffusa
aagacaaacctgtaatcgagggttcagttctaggaaatagtagtcaccagtttccatactgtagagatattcaacagtagcagcaccaacataaccaacacacttagcaagccttcttgctgcctgctcaagttgtttgactgtctcaggaggggccaccgtgatcggaccttcttcgatgatctgttgggtaataaata

SEQ ID NO: 1191 - DNA, 200 bp, Commelina diffusa
gaaccctcgattacaggtttgtctttgcttgttggctgaagattcattgttcatcagaactttgtcttctaagtcttggtccttttcaggttgagcatcctgtaactgagtggatagctgaagtcagcttgcctgcggctcaagtttcagttggtatgggcataccactatggcaaattccaggtatgaacttgtaaggg

SEQ ID NO: 1192 - DNA, 200 bp, Commelina diffusa
cccttacaagttcatacctggaatttgccatagtggtatgcccataccaactgaaacttgagccgcaggcaagctgacttcagctatccactcagttacaggatgctcaacctgaaaaggaccaagacttagaagacaaagttctgatgaacaatgaatcttcagccaacaagcaaagacaaacctgtaatcgagggttc

SEQ ID NO: 1193 - DNA, 200 bp, Commelina diffusa
aattccaggtatgaacttgtaagggaattttgcataattaatgcaaaaagcttaagagaaaaagatgtaagtttcttgtgatgctaactctagttataattttggtttctttctttcagaaatcagaagattttatggaaaggagcatggtggaggatatgatgcttggaggaagacatcactttctgcaagtccttttg

SEQ ID NO: 1194 - DNA, 200 bp, Commelina diffusa
caaaaggacttgcagaaagtgatgtcttcctccaagcatcatatcctccaccatgctcctttccataaaatcttctgatttctgaaagaaagaaaccaaaattataactagagttagcatcacaagaaacttacatctttttctcttaagctttttgcattaattatgcaaaattcccttacaagttcatacctggaatt

SEQ ID NO: 1195 - DNA, 200 bp, Commelina diffusa
acatcactttctgcaagtccttttgactttgacaaagcagagtctacaaggccaagaggtcattgtgtagctgttcgtgtgacgagtgaagatccagatgatggcttcaagcccaccagtggcaaagtgcaggtaaatgttgttgaatataggatatttaggcttaatattttctgcagggacactgaccaactttactg

SEQ ID NO: 1196 - DNA, 200 bp, Commelina diffusa
cagtaaagttggtcagtgtccctgcagaaaatattaagcctaaatatcctatattcaacaacatttacctgcactttgccactggtgggcttgaagccatcatctggatcttcactcgtcacacgaacagctacacaatgacctcttggccttgtagactctgctttgtcaaagtcaaaaggacttgcagaaagtgatgt

SEQ ID NO: 1197 - DNA, 200 bp, Commelina diffusa
gcagggacactgaccaactttactgaactgggacttaaatattttcaggagctaaattttaaaagcaagcctaatgtgtgggcatacttctctgttaaggtatgttgtttaagtttttctgggctggctgcccttctttgggttatttctttgatttctatcaattaatgtacaacaacaaaaaaaatcttttaagagtt

SEQ ID NO: 1198 - DNA, 200 bp, Commelina diffusa
aactcttaaaagattttttttgttgttgtacattaattgatagaaatcaaagaaataacccaaagaagggcagccagcccagaaaaacttaaacaacataccttaacagagaagtatgcccacacattaggcttgcttttaaaatttagctcctgaaaatatttaagtcccagttcagtaaagttggtcagtgtccctgc

SEQ ID NO: 1199 - DNA, 200 bp, Commelina diffusa
caacaaaaaaaatcttttaagagttaatataaacaaatgttggaaacaaatgttctggctaaggagatcaaaatataaacttttgtggaaaaaagttgtgtagtttgcaatatgaatacagtgtgatacttagttgattgtgtcttcatttttgtcctaattaaattatattttgtaattattagactaaatgtgcttat

SEQ ID NO: 1200 - DNA, 200 bp, Commelina diffusa
ataagcacatttagtctaataattacaaaatataatttaattaggacaaaaatgaagacacaatcaactaagtatcacactgtattcatattgcaaactacacaacttttttccacaaaagtttatattttgatctccttagccagaacatttgtttccaacatttgtttatattaactcttaaaagattttttttgttg

SEQ ID NO: 1201 - DNA, 200 bp, Commelina diffusa
taattattagactaaatgtgcttatacagacaaatattttgtttgcagtctggtggtggcatccatgaattttctgattctcaatttggtatctccttgacaatgaaagaagttaaattcttttgaatgctgtgaaaaactcttcttaatatttcctattcttctcaggacatgtttttgcatttggggaatctagagcc

SEQ ID NO: 1202 - DNA, 200 bp, Commelina diffusa
ggctctagattccccaaatgcaaaaacatgtcctgagaagaataggaaatattaagaagagtttttcacagcattcaaaagaatttaacttctttcattgtcaaggagataccaaattgagaatcagaaaattcatggatgccaccaccagactgcaaacaaaatatttgtctgtataagcacatttagtctaataatta

SEQ ID NO: 1203 - DNA, 200 bp, Commelina diffusa
ttttgcatttggggaatctagagccttggcgatagctaacatggttcttggactgaaggagatccaaattcgtggggaaattcgaacaaatgttgattacacaattgatctattaaatgtaagctcttgatcttcttgttacctctaatccaacttattgcaattgcacgtctttgttctcatccgctgcctcacaggca

SEQ ID NO: 1204 - DNA, 200 bp, Commelina diffusa
tgcctgtgaggcagcggatgagaacaaagacgtgcaattgcaataagttggattagaggtaacaagaagatcaagagcttacatttaatagatcaattgtgtaatcaacatttgttcgaatttccccacgaatttggatctccttcagtccaagaaccatgttagctatcgccaaggctctagattccccaaatgcaaaa

SEQ ID NO: 1205 - DNA, 200 bp, Commelina diffusa
gttctcatccgctgcctcacaggcatcagaatacagagacaacaaaatccacactggttggctggatagcagaatagcaatgagggtcagagctgagaggcctccatggtacctttcagttgttggaggagctctttatgtaagaatcgaagcataatgtaatctagttatagttctggtaggttaagttgttatttata

SEQ ID NO: 1206 - DNA, 200 bp, Commelina diffusa
tataaataacaacttaacctaccagaactataactagattacattatgcttcgattcttacataaagagctcctccaacaactgaaaggtaccatggaggcctctcagctctgaccctcattgctattctgctatccagccaaccagtgtggattttgttgtctctgtattctgatgcctgtgaggcagcggatgagaac

SEQ ID NO: 1207 - DNA, 200 bp, Commelina diffusa
ctggtaggttaagttgttatttatatacttgacttattttgtgtcttcagaaagcaacaactagcagtgctgccattgtttccgaatatgttggttatcttggtaaaggtcaaatcccaccaaaggtataatgcatcccagctgtttatgtcgtattttattttcttcgattagttcattaacaaggaaaagcaatgcag

SEQ ID NO: 1208 - DNA, 200 bp, Commelina diffusa
ctgcattgcttttccttgttaatgaactaatcgaagaaaataaaatacgacataaacagctgggatgcattatacctttggtgggatttgacctttaccaagataaccaacatattcggaaacaatggcagcactgctagttgttgctttctgaagacacaaaataagtcaagtatataaataacaacttaacctaccag

SEQ ID NO: 1209 - DNA, 200 bp, Commelina diffusa
tcattaacaaggaaaagcaatgcagcacatttcgctggtcaaaactcttgtgactctgaatattgaagggagcaaatacacggtaaacttcactatttccaaaagttttcattcttaattttctttcaagagacacttcacctaaactccttgctgaatgtttcttagattgaaatggttcgaggtggacctggtagtta

SEQ ID NO: 1210 - DNA, 200 bp, Commelina diffusa
taactaccaggtccacctcgaaccatttcaatctaagaaacattcagcaaggagtttaggtgaagtgtctcttgaaagaaaattaagaatgaaaacttttggaaatagtgaagtttaccgtgtatttgctcccttcaatattcagagtcacaagagttttgaccagcgaaatgtgctgcattgcttttccttgttaatga

SEQ ID NO: 1211 - DNA, 200 bp, Commelina diffusa
tggttcgaggtggacctggtagttataaattaaaaatgaatggttcagagattgaagctgaaattcatactctccgtgatggtggacttctgatgcaggtaaactttctaaatcatcatgttccattgtgtattttttttattttaaacaatgactagctagtttcagtggcaaagcaagcattccaatatgctaagcct

SEQ ID NO: 1212 - DNA, 200 bp, Commelina diffusa
aggcttagcatattggaatgcttgctttgccactgaaactagctagtcattgtttaaaataaaaaaaatacacaatggaacatgatgatttagaaagtttacctgcatcagaagtccaccatcacggagagtatgaatttcagcttcaatctctgaaccattcatttttaatttataactaccaggtccacctcgaacca

SEQ ID NO: 1213 - DNA, 200 bp, Commelina diffusa
gcaagcattccaatatgctaagcctgttaacagtattgatgctgctgtaaaattgccccgtatggtccatgagagtacaaatggtattaccatagtgatctgattgttcatttgcatttgatctaactttccagaatttccagtcttcttcatactctatttttcttaataagataatgtaccgacaacttgatgatgga

SEQ ID NO: 1214 - DNA, 200 bp, Commelina diffusa
tccatcatcaagttgtcggtacattatcttattaagaaaaatagagtatgaagaagactggaaattctggaaagttagatcaaatgcaaatgaacaatcagatcactatggtaataccatttgtactctcatggaccatacggggcaattttacagcagcatcaatactgttaacaggcttagcatattggaatgcttgc

SEQ ID NO: 1215 - DNA, 200 bp, Commelina diffusa
aatgtaccgacaacttgatgatggaagctttgtaagtacctgaaaattttttaggtattggttctgatttcagcactaaggtttataccataaacttcaatactaagtggtcagttaaactttggatctttgcacatcagacttgtcagaactgttttgtttacaatcatccacaattggttatggggtgataattatgg

SEQ ID NO: 1216 - DNA, 200 bp, Commelina diffusa
ccataattatcaccccataaccaattgtggatgattgtaaacaaaacagttctgacaagtctgatgtgcaaagatccaaagtttaactgaccacttagtattgaagtttatggtataaaccttagtgctgaaatcagaaccaatacctaaaaaattttcaggtacttacaaagcttccatcatcaagttgtcggtacatt

SEQ ID NO: 1217 - DNA, 200 bp, Commelina diffusa
attggttatggggtgataattatggatgctttgtgattgttggccatcctgctgctcagaaattatcttgaactttatttgcccccaaatttgaatcatcttttttttgggaattctctttagtttcttttctttctgcaccaatgtttttgttctacatgcccatattgactgcacttgtgcacaactgcacgtctgca

SEQ ID NO: 1218 - DNA, 200 bp, Commelina diffusa
tgcagacgtgcagttgtgcacaagtgcagtcaatatgggcatgtagaacaaaaacattggtgcagaaagaaaagaaactaaagagaattcccaaaaaaaagatgattcaaatttgggggcaaataaagttcaagataatttctgagcagcaggatggccaacaatcacaaagcatccataattatcaccccataaccaat

SEQ ID NO: 1219 - DNA, 200 bp, Commelina diffusa
acttgtgcacaactgcacgtctgcacgtctgcacgcatatatcactctaggaatacagttgatattctcaattctcgatcttgtcatatggttaaagtaatttagcagttcagatcttgaacatatttaatttctaaaactctatgaaattcatacagttggatggaaacagccatgtgatatatgctgaagaggaggct

SEQ ID NO: 1220 - DNA, 200 bp, Commelina diffusa
agcctcctcttcagcatatatcacatggctgtttccatccaactgtatgaatttcatagagttttagaaattaaatatgttcaagatctgaactgctaaattactttaaccatatgacaagatcgagaattgagaatatcaactgtattcctagagtgatatatgcgtgcagacgtgcagacgtgcagttgtgcacaagt

SEQ ID NO: 1221 - DNA, 200 bp, Commelina diffusa
tgtgatatatgctgaagaggaggctgctggtacacgccttcttatcgatggaaggacttgcttgttacaggtagaaacaacttatatatttttcaaaatttttagtttcttgaaggaaattaaatttatttattatctgctagtagaattaatgtaagggaccttttatgatgttttgacattatatattgaaggttctt

SEQ ID NO: 1222 - DNA, 200 bp, Commelina diffusa
aagaaccttcaatatataatgtcaaaacatcataaaaggtcccttacattaattctactagcagataataaataaatttaatttccttcaagaaactaaaaattttgaaaaatatataagttgtttctacctgtaacaagcaagtccttccatcgataagaaggcgtgtaccagcagcctcctcttcagcatatatcaca

SEQ ID NO: 1223 - DNA, 200 bp, Commelina diffusa
ttgacattatatattgaaggttctttgatttattaaaaaatgcataagatagatagattgcagtattgcactttgcatctttcaagtgcgcttatgctcaacatgcttaaggtgcttactgcttagattgcccagtgctgctcaaaacttgcatagaactgtgaaaaccattatttcttttgttctatccctaatgtgaa

SEQ ID NO: 1224 - DNA, 200 bp, Commelina diffusa
ttcacattagggatagaacaaaagaaataatggttttcacagttctatgcaagttttgagcagcactgggcaatctaagcagtaagcaccttaagcatgttgagcataagcgcacttgaaagatgcaaagtgcaatactgcaatctatctatcttatgcattttttaataaatcaaagaaccttcaatatataatgtcaa

SEQ ID NO: 1225 - DNA, 200 bp, Commelina diffusa
tcttttgttctatccctaatgtgaaagcttctgtgcgcctgctccggccctactctaatcttcattagcttctttgcactgatttatgtgatattttcttggactgttcatggtccttgctaagagttcctaagtatctgatgtttgtttatgttaatttttgcattccattcctttttagttctaaatgattgtttcta

SEQ ID NO: 1226 - DNA, 200 bp, Commelina diffusa
tagaaacaatcatttagaactaaaaaggaatggaatgcaaaaattaacataaacaaacatcagatacttaggaactcttagcaaggaccatgaacagtccaagaaaatatcacataaatcagtgcaaagaagctaatgaagattagagtagggccggagcaggcgcacagaagctttcacattagggatagaacaaaaga

SEQ ID NO: 1227 - DNA, 200 bp, Commelina diffusa
ttttagttctaaatgattgtttctatcggtcaaactaaatgctgcaacttagttatcagttgcactcaccctattcaaatgaaatttaaggtacatttcacaaatgggattaacacattaaaaacactttatgtgttaacatgctactattagaaatccagatatgttatttcagaatcataaagcaacgttagatggct

SEQ ID NO: 1228 - DNA, 200 bp, Commelina diffusa
agccatctaacgttgctttatgattctgaaataacatatctggatttctaatagtagcatgttaacacataaagtgtttttaatgtgttaatcccatttgtgaaatgtaccttaaatttcatttgaatagggtgagtgcaactgataactaagttgcagcatttagtttgaccgatagaaacaatcatttagaactaaaa

SEQ ID NO: 1229 - DNA, 200 bp, Commelina diffusa
aatcataaagcaacgttagatggcttcataaactgtgaataagtggtaaagaattccttcctagatattattgaagaaagtttctcttgaacaagttaccttaaataattaatcataactggttttgtcttcagaatgatcatgatccatcgaaattgattgcggagacaccatgcaaacttcttcgctacttgattgct

SEQ ID NO: 1230 - DNA, 200 bp, Commelina diffusa
agcaatcaagtagcgaagaagtttgcatggtgtctccgcaatcaatttcgatggatcatgatcattctgaagacaaaaccagttatgattaattatttaaggtaacttgttcaagagaaactttcttcaataatatctaggaaggaattctttaccacttattcacagtttatgaagccatctaacgttgctttatgatt

SEQ ID NO: 1231 - DNA, 200 bp, Commelina diffusa
caaacttcttcgctacttgattgctgatggagagcatcttgatgctgatgcaccatatgcagaggtcgaagtaatgaagatgtgcatgccccttttgttacctgcttctggagttattcattttgtgatgtctgaaggtcaggctatgcaggtaagtaaaccttgtaaagattagaaagaaagtttctcttgtgttttct

SEQ ID NO: 1232 - DNA, 200 bp, Commelina diffusa
agaaaacacaagagaaactttctttctaatctttacaaggtttacttacctgcatagcctgaccttcagacatcacaaaatgaataactccagaagcaggtaacaaaaggggcatgcacatcttcattacttcgacctctgcatatggtgcatcagcatcaagatgctctccatcagcaatcaagtagcgaagaagtttg

SEQ ID NO: 1233 - DNA, 200 bp, Commelina diffusa
aaagaaagtttctcttgtgttttctcataaactacatagaatcttgtttttgcaggctggtgacctcatagcaaggctcgacttagacgatccatctgctgtaagaagagctgaaccattcaatggtacattccctaaagtaggtcctcccactgcagtttctgacagagttcaccagagatgtgctgcaagtttgaatg

SEQ ID NO: 1234 - DNA, 200 bp, Commelina diffusa
cattcaaacttgcagcacatctctggtgaactctgtcagaaactgcagtgggaggacctactttagggaatgtaccattgaatggttcagctcttcttacagcagatggatcgtctaagtcgagccttgctatgaggtcaccagcctgcaaaaacaagattctatgtagtttatgagaaaacacaagagaaactttcttt

SEQ ID NO: 1235 - DNA, 200 bp, Commelina diffusa
cagagatgtgctgcaagtttgaatgctgcacgcatgattcttgcaggatatgaacataatattaatgaagtaagggctaacgattaaactttttttttattctttgttatttttaattaattcaaagtgctatctacttttatttctttatactttaagtggcatttctattaactaaaacatatgttttttactaccct

SEQ ID NO: 1236 - DNA, 200 bp, Commelina diffusa
agggtagtaaaaaacatatgttttagttaatagaaatgccacttaaagtataaagaaataaaagtagatagcactttgaattaattaaaaataacaaagaataaaaaaaaagtttaatcgttagcccttacttcattaatattatgttcatatcctgcaagaatcatgcgtgcagcattcaaacttgcagcacatctctg

SEQ ID NO: 1237 - DNA, 200 bp, Commelina diffusa
taaaacatatgttttttactaccctttgccaatgttgattagaccaaaatgggtttaaactcttttatgatgcattctaataatctttatttgctgaacctttttagttactttcaaatttatgtagagattaaagcttttattcgaaaacgccaccatacatacacctcatccttggaaaatggaatgtatacaatttg

SEQ ID NO: 1238 - DNA, 200 bp, Commelina diffusa
caaattgtatacattccattttccaaggatgaggtgtatgtatggtggcgttttcgaataaaagctttaatctctacataaatttgaaagtaactaaaaaggttcagcaaataaagattattagaatgcatcataaaagagtttaaacccattttggtctaatcaacattggcaaagggtagtaaaaaacatatgtttta

SEQ ID NO: 1239 - DNA, 200 bp, Commelina diffusa
tggaaaatggaatgtatacaatttgctgattttagttccatcaaatcccagtttagtcacaaggaatcatgctgataagatgctaaatttgtgctaccatgtgcagtgatccatgtctgcagctttgtatatatgccttgtggagattagacgtccatttgtcttatctttttagtttccccaccttcaactttggtgac

SEQ ID NO: 1240 - DNA, 200 bp, Commelina diffusa
gtcaccaaagttgaaggtggggaaactaaaaagataagacaaatggacgtctaatctccacaaggcatatatacaaagctgcagacatggatcactgcacatggtagcacaaatttagcatcttatcagcatgattccttgtgactaaactgggatttgatggaactaaaatcagcaaattgtatacattccattttcca

SEQ ID NO: 1241 - DNA, 200 bp, Commelina diffusa
tttccccaccttcaactttggtgaccgctgcccttaatgtttattttaaggagaagcatcatgcttttgagaaattggttgcttctatcagatgactgaacacctttttatttttatatatcttgttctaatcatgctaagtttcattgaatttctctttatgttttccaattttaaactgatggttatgctatgccaaa

SEQ ID NO: 1242 - DNA, 200 bp, Commelina diffusa
tttggcatagcataaccatcagtttaaaattggaaaacataaagagaaattcaatgaaacttagcatgattagaacaagatatataaaaataaaaaggtgttcagtcatctgatagaagcaaccaatttctcaaaagcatgatgcttctccttaaaataaacattaagggcagcggtcaccaaagttgaaggtggggaaa

SEQ ID NO: 1243 - DNA, 200 bp, Commelina diffusa
aaactgatggttatgctatgccaaagtgactaggctctattgtaattttaactgcaaagggactatttgatgattgacactttactttttgttttaattcttttagtttaccattttatatacttgttacttatatgaactgcaacttgcattactgtatacaattttaaaattgtttctttcctttatgcatatactgg

SEQ ID NO: 1244 - DNA, 200 bp, Commelina diffusa
ccagtatatgcataaaggaaagaaacaattttaaaattgtatacagtaatgcaagttgcagttcatataagtaacaagtatataaaatggtaaactaaaagaattaaaacaaaaagtaaagtgtcaatcatcaaatagtccctttgcagttaaaattacaatagagcctagtcactttggcatagcataaccatcagttt

SEQ ID NO: 1245 - DNA, 200 bp, Commelina diffusa
tttctttcctttatgcatatactggtttgcatttttttctctaacgtcccaagtataaataggttgttcaagagttactacattgtttggatagtccggagcttccttttctacagtggcaggaaagtatgtctgtattggcaactcgcctgccgaaagaacttaaaaatgaggtttgtgcatagttcttaattttttgt

SEQ ID NO: 1246 - DNA, 200 bp, Commelina diffusa
acaaaaaattaagaactatgcacaaacctcatttttaagttctttcggcaggcgagttgccaatacagacatactttcctgccactgtagaaaaggaagctccggactatccaaacaatgtagtaactcttgaacaacctatttatacttgggacgttagagaaaaaaatgcaaaccagtatatgcataaaggaaagaaa

SEQ ID NO: 1247 - DNA, 200 bp, Commelina diffusa
ttgtgcatagttcttaattttttgtcagaagcacatagtctagtttccagttggacagttggattgtacatttcccaaatttaataattttatgtgcaatttcttatttgatacagttggattctaaatacaaagtatttgaaacaaactcaaacgttcaaaagaatgtggaatttcctgccaagcttctgagtggagtt

SEQ ID NO: 1248 - DNA, 200 bp, Commelina diffusa
aactccactcagaagcttggcaggaaattccacattcttttgaacgtttgagtttgtttcaaatactttgtatttagaatccaactgtatcaaataagaaattgcacataaaattattaaatttgggaaatgtacaatccaactgtccaactggaaactagactatgtgcttctgacaaaaaattaagaactatgcacaa

SEQ ID NO: 1249 - DNA, 200 bp, Commelina diffusa
tcctgccaagcttctgagtggagttattgaggttagtatgttttagtatgaatatcactcaaataataaggttttaaaactttatttcctcgatctgcagagctatctctcatcttgtagtgagaaagataaggcggcacaggaaaggcttgtggaaccacttctgagccttgcgaagtcatacgaaggtggaagagaaa

SEQ ID NO: 1250 - DNA, 200 bp, Commelina diffusa
tttctcttccaccttcgtatgacttcgcaaggctcagaagtggttccacaagcctttcctgtgccgccttatctttctcactacaagatgagagatagctctgcagatcgaggaaataaagttttaaaaccttattatttgagtgatattcatactaaaacatactaacctcaataactccactcagaagcttggcagga

SEQ ID NO: 1251 - DNA, 200 bp, Commelina diffusa
aagtcatacgaaggtggaagagaaagccatgctcgtgtaattgtgcattctctttttgaagagtacttatctgttgaagagttattcagtgatagcattcaggtgattgtttatccgaagttcattcaaactttttcgactaactcttccatcaaaataaatactaaaggaacaaaactgattctcaatgtttttgaaag

SEQ ID NO: 1252 - DNA, 200 bp, Commelina diffusa
ctttcaaaaacattgagaatcagttttgttcctttagtatttattttgatggaagagttagtcgaaaaagtttgaatgaacttcggataaacaatcacctgaatgctatcactgaataactcttcaacagataagtactcttcaaaaagagaatgcacaattacacgagcatggctttctcttccaccttcgtatgactt

SEQ ID NO: 1253 - DNA, 200 bp, Commelina diffusa
aactgattctcaatgtttttgaaagtttcgttgctccagctagattttccaaaggccttaaccatgcatttttcttgtataggccgatgtcatagaacgcctacgacttcaataccagaaggatcttctgaaagttgtagacatagtgctgtctcatcaggtatatttgcaacgtctgaagttgttttattttactccat

SEQ ID NO: 1254 - DNA, 200 bp, Commelina diffusa
atggagtaaaataaaacaacttcagacgttgcaaatatacctgatgagacagcactatgtctacaactttcagaagatccttctggtattgaagtcgtaggcgttctatgacatcggcctatacaagaaaaatgcatggttaaggcctttggaaaatctagctggagcaacgaaactttcaaaaacattgagaatcagtt

SEQ ID NO: 1255 - DNA, 200 bp, Commelina diffusa
ctgaagttgttttattttactccatagaattgaccaattctccttaaagtaacatgaatgctgataattcaccttttagtttctctgtggatgagatacatctcgtatgctagtttttccattaacaatatgccgtttttgtttactaaagggtgttagaagtaaaaataagctgatactgaggttgatggaagcattgg

SEQ ID NO: 1256 - DNA, 200 bp, Commelina diffusa
ccaatgcttccatcaacctcagtatcagcttatttttacttctaacaccctttagtaaacaaaaacggcatattgttaatggaaaaactagcatacgagatgtatctcatccacagagaaactaaaaggtgaattatcagcattcatgttactttaaggagaattggtcaattctatggagtaaaataaaacaacttcag

SEQ ID NO: 1257 - DNA, 200 bp, Commelina diffusa
atactgaggttgatggaagcattggtctatcctaatcctgctgcctatcgggaacaactgattcgcttctctgctcttaaccataccacttactccgaggtcaataatcttactggatatcttgcacctatcccttcatgtttgtaattcttttgctcacattggcctatccttactcgtgcttggtcaatatggttcct

SEQ ID NO: 1258 - DNA, 200 bp, Commelina diffusa
aggaaccatattgaccaagcacgagtaaggataggccaatgtgagcaaaagaattacaaacatgaagggataggtgcaagatatccagtaagattattgacctcggagtaagtggtatggttaagagcagagaagcgaatcagttgttcccgataggcagcaggattaggatagaccaatgcttccatcaacctcagtat

SEQ ID NO: 1259 - DNA, 200 bp, Commelina diffusa
ctcgtgcttggtcaatatggttcctgcagttagcattgaaagccagtcaactccttgaacaaactaaattgagtgagcttcgaacaagcattgccagaagcctttccgagctagaaatgtttacagaagaaggtgaacgtctatctacaccgagaaggaaaagtgctatcaatgagaggatggaggatcttgtaagtgct

SEQ ID NO: 1260 - DNA, 200 bp, Commelina diffusa
agcacttacaagatcctccatcctctcattgatagcacttttccttctcggtgtagatagacgttcaccttcttctgtaaacatttctagctcggaaaggcttctggcaatgcttgttcgaagctcactcaatttagtttgttcaaggagttgactggctttcaatgctaactgcaggaaccatattgaccaagcacgag

SEQ ID NO: 1261 - DNA, 200 bp, Commelina diffusa
gaggatggaggatcttgtaagtgctacgctggccgttgaagatgcacttgtgtctttgtttgatcacactgatccaactgttcagagacgagtgatggaaacatatgtccgaagattgtaccaggtaccaaactgaagtaatatggtaacaaacatgtagctgttaaatatttatctgacactgcttttttctcagccct

SEQ ID NO: 1262 - DNA, 200 bp, Commelina diffusa
agggctgagaaaaaagcagtgtcagataaatatttaacagctacatgtttgttaccatattacttcagtttggtacctggtacaatcttcggacatatgtttccatcactcgtctctgaacagttggatcagtgtgatcaaacaaagacacaagtgcatcttcaacggccagcgtagcacttacaagatcctccatcctc

SEQ ID NO: 1263 - DNA, 200 bp, Commelina diffusa
ctgacactgcttttttctcagccctaccttgtgaaggatagtgtccgaatgcagtggcaccgttctggtttgatcgcgacatgggaattcaccgaagaacatattgagaaaaagaatgattcttctacacaagataagtcatttatggagaaacattgtcaaaagagatggggagctatggttatcgtcaaatctctcca

SEQ ID NO: 1264 - DNA, 200 bp, Commelina diffusa
tggagagatttgacgataaccatagctccccatctcttttgacaatgtttctccataaatgacttatcttgtgtagaagaatcattctttttctcaatatgttcttcggtgaattcccatgtcgcgatcaaaccagaacggtgccactgcattcggacactatccttcacaaggtagggctgagaaaaaagcagtgtcag

SEQ ID NO: 1265 - DNA, 200 bp, Commelina diffusa
ctatggttatcgtcaaatctctccagtttcttccagcagcaattagtgcagcattgaaggaaaccagtcatctgtcatctgatactgatcatgatacagtatctaatgggcttcctcaacatgctagtcaaggcaatatgcttcatgttgcattggttggcattaacaatcaaatgagtacacttcaggataggtaactt

SEQ ID NO: 1266 - DNA, 200 bp, Commelina diffusa
aagttacctatcctgaagtgtactcatttgattgttaatgccaaccaatgcaacatgaagcatattgccttgactagcatgttgaggaagcccattagatactgtatcatgatcagtatcagatgacagatgactggtttccttcaatgctgcactaattgctgctggaagaaactggagagatttgacgataaccatag

SEQ ID NO: 1267 - DNA, 200 bp, Commelina diffusa
gagtacacttcaggataggtaacttaattattcttgaatatttccatcatatggtatgtttgtggtaatttgatcatttagttatgaaaggtgcagtcttgtgcttatctttgaatctttttaatggacaaatgttccttgatcatattacagtggagatgaggatcaggctcaggagaggatacacaagcttgccaaga

SEQ ID NO: 1268 - DNA, 200 bp, Commelina diffusa
tcttggcaagcttgtgtatcctctcctgagcctgatcctcatctccactgtaatatgatcaaggaacatttgtccattaaaaagattcaaagataagcacaagactgcacctttcataactaaatgatcaaattaccacaaacataccatatgatggaaatattcaagaataattaagttacctatcctgaagtgtactc

SEQ ID NO: 1269 - DNA, 200 bp, Commelina diffusa
gagaggatacacaagcttgccaagattctaaaagataacaaggtagcgactgaactttccaatgctggagtccgagttgttagctgtattatacaaagagatgaaggacgaacacctatgcgtcactccttccattggtctgccgataagcaatgctatgaagaagaacccttgcttcgtcatctggaacctcctctgtc

SEQ ID NO: 1270 - DNA, 200 bp, Commelina diffusa
gacagaggaggttccagatgacgaagcaagggttcttcttcatagcattgcttatcggcagaccaatggaaggagtgacgcataggtgttcgtccttcatctctttgtataatacagctaacaactcggactccagcattggaaagttcagtcgctaccttgttatcttttagaatcttggcaagcttgtgtatcctctc

SEQ ID NO: 1271 - DNA, 200 bp, Commelina diffusa
ttcgtcatctggaacctcctctgtctactttccttgaattggttggtgaatgtttttaacttattttattcacatctttattgtaattccctttctctgattaatgccatttgttattgattccattgcaggataagctgaaaggctacaaaaatatacaatacacaccatcacgggatcgccagtggcatatgtacaca

SEQ ID NO: 1272 - DNA, 200 bp, Commelina diffusa
tgtgtacatatgccactggcgatcccgtgatggtgtgtattgtatatttttgtagcctttcagcttatcctgcaatggaatcaataacaaatggcattaatcagagaaagggaattacaataaagatgtgaataaaataagttaaaaacattcaccaaccaattcaaggaaagtagacagaggaggttccagatgacgaa

SEQ ID NO: 1273 - DNA, 200 bp, Commelina diffusa
ggatcgccagtggcatatgtacacagttcaagaaactaaaccacttaatcagaggatgtttctgaggacccttgtcagacaaccaaggataaataatggattttcatcaaaccagcttcccgaattagaaactagacatgatttatcctttacatcagtcagcttgttgagatctttgatggcagcattggaagagttag

SEQ ID NO: 1274 - DNA, 200 bp, Commelina diffusa
ctaactcttccaatgctgccatcaaagatctcaacaagctgactgatgtaaaggataaatcatgtctagtttctaattcgggaagctggtttgatgaaaatccattatttatccttggttgtctgacaagggtcctcagaaacatcctctgattaagtggtttagtttcttgaactgtgtacatatgccactggcgatcc

SEQ ID NO: 1275 - DNA, 200 bp, Commelina diffusa
ttgatggcagcattggaagagttagaactacatgtccatagcgaaacaatcagatctgatcattctcacatgtatctctgcatattacaagaacaacaactctccgatcttttacctcgttcagggtaagtcttgttgtctagttagtttggtgtattcttctgaaaaatgtttgtttgtagattaaaaaaaaaatgtag

SEQ ID NO: 1276 - DNA, 200 bp, Commelina diffusa
ctacattttttttttaatctacaaacaaacatttttcagaagaatacaccaaactaactagacaacaagacttaccctgaacgaggtaaaagatcggagagttgttgttcttgtaatatgcagagatacatgtgagaatgatcagatctgattgtttcgctatggacatgtagttctaactcttccaatgctgccatcaa

SEQ ID NO: 1277 - DNA, 200 bp, Commelina diffusa
tttgtagattaaaaaaaaaatgtagtgtttttggctaaactgatttctcctttgctttggctaaaacattttttggaagtttccatgtttttggaaattattctttaagggctgtttggatacctataatgagggttataatgtggatacttgtagttagtgattttagtgtagttggaaagtaaaacataggtggtaaa

SEQ ID NO: 1278 - DNA, 200 bp, Commelina diffusa
tttaccacctatgttttactttccaactacactaaaatcactaactacaagtatccacattataaccctcattataggtatccaaacagcccttaaagaataatttccaaaaacatggaaacttccaaaaaatgttttagccaaagcaaaggagaaatcagtttagccaaaaacactacattttttttttaatctacaaa

SEQ ID NO: 1279 - DNA, 200 bp, Commelina diffusa
tggaaagtaaaacataggtggtaaactacatctcaacatctccaaatttggtgttgttgctatgatgtagtcacatgacgtgccaattttggtgtagttcccaaaattttttttaggtaaaatatatttacaaatatcgcacaagtttattcatctattagtatttcgtgtaaagatatctataaaattaagcaaacaat

SEQ ID NO: 1280 - DNA, 200 bp, Commelina diffusa
attgtttgcttaattttatagatatctttacacgaaatactaatagatgaataaacttgtgcgatatttgtaaatatattttacctaaaaaaaattttgggaactacaccaaaattggcacgtcatgtgactacatcatagcaacaacaccaaatttggagatgttgagatgtagtttaccacctatgttttactttcca

SEQ ID NO: 1281 - DNA, 200 bp, Commelina diffusa
atatctataaaattaagcaaacaatgaagttgtagttcttttcaactatagctacatgcactatcaactagaactacaagcatccatgtcacaatgttcattaagttaaataatataattttaaaataatttttatttatttattaaaatatagtcatgaggagactttcgaaaataaatttcagaacaaacaaacgcat

SEQ ID NO: 1282 - DNA, 200 bp, Commelina diffusa
atgcgtttgtttgttctgaaatttattttcgaaagtctcctcatgactatattttaataaataaataaaaattattttaaaattatattatttaacttaatgaacattgtgacatggatgcttgtagttctagttgatagtgcatgtagctatagttgaaaagaactacaacttcattgtttgcttaattttatagatat

SEQ ID NO: 1283 - DNA, 200 bp, Commelina diffusa
taaatttcagaacaaacaaacgcattttttattccaaaatatcatattgttgcttttagataactatttactgagaatgaatttgaacattgtttcaagaaacccttcaaaacaagcaaagtaaatttgtgttctcatcttcgtgctctagatactttgttcatttacttctttcgttagtcattttttgaagttctaac

SEQ ID NO: 1284 - DNA, 200 bp, Commelina diffusa
gttagaacttcaaaaaatgactaacgaaagaagtaaatgaacaaagtatctagagcacgaagatgagaacacaaatttactttgcttgttttgaagggtttcttgaaacaatgttcaaattcattctcagtaaatagttatctaaaagcaacaatatgatattttggaataaaaaatgcgtttgtttgttctgaaattta

SEQ ID NO: 1285 - DNA, 200 bp, Commelina diffusa
gttagtcattttttgaagttctaactaactcaagcattcaatttgtccagtactcttgatcctgatgcctatcagaatgaaagtcaagtgtccctgcttttaaaagatatggctgtcaggattcatgagatagttggtgtaaggatgcatcgtcttactgttattgagtgggaggtaaagctctggttgggttctgatgg

SEQ ID NO: 1286 - DNA, 200 bp, Commelina diffusa
ccatcagaacccaaccagagctttacctcccactcaataacagtaagacgatgcatccttacaccaactatctcatgaatcctgacagccatatcttttaaaagcagggacacttgactttcattctgataggcatcaggatcaagagtactggacaaattgaatgcttgagttagttagaacttcaaaaaatgactaac

SEQ ID NO: 1287 - DNA, 200 bp, Commelina diffusa
taaagctctggttgggttctgatggtgttgctggtggttcttggagggttgtggtgacaaatgttactggacgtacatgtaatgtccatgtaagtgcgattgattcactttgtctaagactttactactatacttgcatggttagacataatatttcatttccttatgtaggtaacgttttctagcatagctaattgttt

SEQ ID NO: 1288 - DNA, 200 bp, Commelina diffusa
aaacaattagctatgctagaaaacgttacctacataaggaaatgaaatattatgtctaaccatgcaagtatagtagtaaagtcttagacaaagtgaatcaatcgcacttacatggacattacatgtacgtccagtaacatttgtcaccacaaccctccaagaaccaccagcaacaccatcagaacccaaccagagcttta

SEQ ID NO: 1289 - DNA, 200 bp, Commelina diffusa
cgttttctagcatagctaattgtttgactaggactatattaactaattgtaaaaattgaacttttgccattagagcagttaattaatagatattgctctagcccgtaattttgctttcatttgattgtaaaatactcagtaagtttttgcttcagatttaccgagaattggaggacagcaaatcacatgaagtggtctat

SEQ ID NO: 1290 - DNA, 200 bp, Commelina diffusa
atagaccacttcatgtgatttgctgtcctccaattctcggtaaatctgaagcaaaaacttactgagtattttacaatcaaatgaaagcaaaattacgggctagagcaatatctattaattaactgctctaatggcaaaagttcaatttttacaattagttaatatagtcctagtcaaacaattagctatgctagaaaacg

SEQ ID NO: 1291 - DNA, 200 bp, Commelina diffusa
cagcaaatcacatgaagtggtctatcactctgcagcttcagtcacaggacctctccatggtatgccgttgattgctagatatcagccacttagtgttattgataaaaaacgatgggtggcaagaaggagcaacactacttattgctatgactttccactggtatagctcccaattcctgattgatatactcccagttttc

SEQ ID NO: 1292 - DNA, 200 bp, Commelina diffusa
gaaaactgggagtatatcaatcaggaattgggagctataccagtggaaagtcatagcaataagtagtgttgctccttcttgccacccatcgttttttatcaataacactaagtggctgatatctagcaatcaacggcataccatggagaggtcctgtgactgaagctgcagagtgatagaccacttcatgtgatttgctg

SEQ ID NO: 1293 - DNA, 200 bp, Commelina diffusa
cctgattgatatactcccagttttcttgttttgatacttcaataccttactaattaatatgtgcaggcgtttgagacagcactgaagcagtcatgggcttcttatagtgatactaaagcaccagaaagcaaagctcttctccaagttcaagaacttatgtttgttgacaaaaagggatcatggggtactcctgttgaacc

SEQ ID NO: 1294 - DNA, 200 bp, Commelina diffusa
ggttcaacaggagtaccccatgatccctttttgtcaacaaacataagttcttgaacttggagaagagctttgctttctggtgctttagtatcactataagaagcccatgactgcttcagtgctgtctcaaacgcctgcacatattaattagtaaggtattgaagtatcaaaacaagaaaactgggagtatatcaatcagg

SEQ ID NO: 1295 - DNA, 200 bp, Commelina diffusa
gatcatggggtactcctgttgaacctgtatgctgcccacctggtctcagtgatattggcatggttgcttggtcaatggaaatgtacacaccagaatttcccgaaggaaggaagattgttgttgtagccaatgatttgactttcaaagcaggctcctttgggcctcgtgaagatgcatttttccatgctgtaaccaattat

SEQ ID NO: 1296 - DNA, 200 bp, Commelina diffusa
ataattggttacagcatggaaaaatgcatcttcacgaggcccaaaggagcctgctttgaaagtcaaatcattggctacaacaacaatcttccttccttcgggaaattctggtgtgtacatttccattgaccaagcaaccatgccaatatcactgagaccaggtgggcagcatacaggttcaacaggagtaccccatgatc

SEQ ID NO: 1297 - DNA, 200 bp, Commelina diffusa
atttttccatgctgtaaccaattatgcatgtgataagaggctccctctaatctatttggcagcaaattctggcgccaggattggtgctgctgaagaggtcaagtcttgctttaaggttggatggtctgatgagtcgagtccagaacgtggttttcagtatgtgtatctgacacaggaggactataaccgtattggttcat

SEQ ID NO: 1298 - DNA, 200 bp, Commelina diffusa
atgaaccaatacggttatagtcctcctgtgtcagatacacatactgaaaaccacgttctggactcgactcatcagaccatccaaccttaaagcaagacttgacctcttcagcagcaccaatcctggcgccagaatttgctgccaaatagattagagggagcctcttatcacatgcataattggttacagcatggaaaaat

SEQ ID NO: 1299 - DNA, 200 bp, Commelina diffusa
gaggactataaccgtattggttcatctgttattgcacatgaactgaagcttgaaagtggtgagatcagatgggtgatcgacacaattgttggcaaagatgatgacttgggtgttgagaacctcactggcagtggtgcaattgccggtgcttattccagggcttataacgaggtatttactcttacatatgtgactggacg

SEQ ID NO: 1300 - DNA, 200 bp, Commelina diffusa
cgtccagtcacatatgtaagagtaaatacctcgttataagccctggaataagcaccggcaattgcaccactgccagtgaggttctcaacacccaagtcatcatctttgccaacaattgtgtcgatcacccatctgatctcaccactttcaagcttcagttcatgtgcaataacagatgaaccaatacggttatagtcctc

SEQ ID NO: 1301 - DNA, 200 bp, Commelina diffusa
ttactcttacatatgtgactggacgtactgtaggaatcggagcctatcttgctcggcttggcatgaggtgtatccagaggctagaccagcctataatcctaacagggttttctacactcaacaagttgcttggccgtgaggtgtacagctcacacatgcaactaggtggcccgaagatcatggctacaaatggtgttgtt

SEQ ID NO: 1302 - DNA, 200 bp, Commelina diffusa
aacaacaccatttgtagccatgatcttcgggccacctagttgcatgtgtgagctgtacacctcacggccaagcaacttgttgagtgtagaaaaccctgttaggattataggctggtctagcctctggatacacctcatgccaagccgagcaagataggctccgattcctacagtacgtccagtcacatatgtaagagtaa

SEQ ID NO: 1303 - DNA, 200 bp, Commelina diffusa
gatcatggctacaaatggtgttgttcatctgacggtatcagatgatcttgagggcgtttctgctattcttaagtggcttagttacgtaccaccctatgtcggtgggccacttccaataataaaatccttggatcccccagaaaggccagtggagtattttcctgaaaattcatgtgatccacgggccgcaatttgcggca

SEQ ID NO: 1304 - DNA, 200 bp, Commelina diffusa
tgccgcaaattgcggcccgtggatcacatgaattttcaggaaaatactccactggcctttctgggggatccaaggattttattattggaagtggcccaccgacatagggtggtacgtaactaagccacttaagaatagcagaaacgccctcaagatcatctgataccgtcagatgaacaacaccatttgtagccatgatc

SEQ ID NO: 1305 - DNA, 200 bp, Commelina diffusa
gatccacgggccgcaatttgcggcattgatgatggcaatggcaagtggttaggtggtatgtttgataaagatagttttacggagacattagaaggttgggcaaagacggtggtcaccggaagagcaaagttgggtggaattccagtaggagttatagctgtcgagacacagactgtgatgcaagtcattcctgcagatcc

SEQ ID NO: 1306 - DNA, 200 bp, Commelina diffusa
ggatctgcaggaatgacttgcatcacagtctgtgtctcgacagctataactcctactggaattccacccaactttgctcttccggtgaccaccgtctttgcccaaccttctaatgtctccgtaaaactatctttatcaaacataccacctaaccacttgccattgccatcatcaatgccgcaaattgcggcccgtggatc

SEQ ID NO: 1307 - DNA, 200 bp, Commelina diffusa
tgatgcaagtcattcctgcagatcctggtcagcttgattcccatgaacgtgttgtcccacaagctggtcaagtttggttccctgattctgccaccaaaacggcacaagcattattagacttcaatcgtgaagaattgccacttttcatactagccaactggagaggattctcaggcggacagagagatctcttcgaaggt

SEQ ID NO: 1308 - DNA, 200 bp, Commelina diffusa
accttcgaagagatctctctgtccgcctgagaatcctctccagttggctagtatgaaaagtggcaattcttcacgattgaagtctaataatgcttgtgccgttttggtggcagaatcagggaaccaaacttgaccagcttgtgggacaacacgttcatgggaatcaagctgaccaggatctgcaggaatgacttgcatca

SEQ ID NO: 1309 - DNA, 200 bp, Commelina diffusa
cggacagagagatctcttcgaaggtatacttcaggctggttccacaatcgtcgaaaacttaaggacatataagcagcctgtatttacctacatcccaatggccggggagcttcgtggtggtgcatgggttgtggtggacagcaaaatcaacccggatcacatcgagatgtatgccgaaagaacagcaaggggcaacgtac

SEQ ID NO: 1310 - DNA, 200 bp, Commelina diffusa
gtacgttgccccttgctgttctttcggcatacatctcgatgtgatccgggttgattttgctgtccaccacaacccatgcaccaccacgaagctccccggccattgggatgtaggtaaatacaggctgcttatatgtccttaagttttcgacgattgtggaaccagcctgaagtataccttcgaagagatctctctgtccg

SEQ ID NO: 1311 - DNA, 200 bp, Commelina diffusa
gaaagaacagcaaggggcaacgtacttgagcccgaaggaatgattgagattaagttcagaactaaagaacttctcgagtgcatgggtagacttgatcctgagctaatcagtttgaaaacaaagcttagggagttgaaggcagctggaccttccagagatgtggacgtcctccagaaaagtgtaacggctagagagaagca

SEQ ID NO: 1312 - DNA, 200 bp, Commelina diffusa
tgcttctctctagccgttacacttttctggaggacgtccacatctctggaaggtccagctgccttcaactccctaagctttgttttcaaactgattagctcaggatcaagtctacccatgcactcgagaagttctttagttctgaacttaatctcaatcattccttcgggctcaagtacgttgccccttgctgttctttc

SEQ ID NO: 1313 - DNA, 200 bp, Commelina diffusa
aaagtgtaacggctagagagaagcagttattgcctgtatatacacaaattgctataaagtttgcagagttgcacgatacatccttgcgaatggctgccaaaggtgtgatcaagaaagtggtagactgggagaactcccgttctttcttctacaaaaggttaaacaggagagtttccgaggatgtccttgcaaaaactgtt

SEQ ID NO: 1314 - DNA, 200 bp, Commelina diffusa
aacagtttttgcaaggacatcctcggaaactctcctgtttaaccttttgtagaagaaagaacgggagttctcccagtctaccactttcttgatcacacctttggcagccattcgcaaggatgtatcgtgcaactctgcaaactttatagcaatttgtgtatatacaggcaataactgcttctctctagccgttacacttt

SEQ ID NO: 1315 - DNA, 200 bp, Commelina diffusa
cgaggatgtccttgcaaaaactgttagagatgctgctggggagcagttgtcgtacaagtctgctattgaactgcttaagcagtggttttcatcttccgacaatgtggacgttggaaaatgggaggaagacgatgctttccttgcctggaaagacaaccctaaaaattatgccaagtatcttgaagagctacgagttcaga

SEQ ID NO: 1316 - DNA, 200 bp, Commelina diffusa
tctgaactcgtagctcttcaagatacttggcataatttttagggttgtctttccaggcaaggaaagcatcgtcttcctcccattttccaacgtccacattgtcggaagatgaaaaccactgcttaagcagttcaatagcagacttgtacgacaactgctccccagcagcatctctaacagtttttgcaaggacatcctcg

SEQ ID NO: 1317 - DNA, 200 bp, Commelina diffusa
tatcttgaagagctacgagttcagaagatattgcagcagctctcagctcttggtgaatcatcttcggatttgcgagtattgcctcaatgtcttgctacagtccttagcaaggtacagtttctttcattgtgcattcaatttctcttttcaaaatatagacatatagttagatttttacttagttttgcatcattttccct

SEQ ID NO: 1318 - DNA, 200 bp, Commelina diffusa
agggaaaatgatgcaaaactaagtaaaaatctaactatatgtctatattttgaaaagagaaattgaatgcacaatgaaagaaactgtaccttgctaaggactgtagcaagacattgaggcaatactcgcaaatccgaagatgattcaccaagagctgagagctgctgcaatatcttctgaactcgtagctcttcaagata

SEQ ID NO: 1319 - DNA, 200 bp, Commelina diffusa
tacttagttttgcatcattttccctgcaacatggtaaacatttctctataagtattttaatatcactgcaaaatattcaataatgttcctgaacttgttcggagcgccttgattagtagctacactagcattgcgatctcacagtaaaagctatcattctctttgaaataattcttttaactctgggtagatattttttc

SEQ ID NO: 1320 - DNA, 200 bp, Commelina diffusa
gaaaaaatatctacccagagttaaaagaattatttcaaagagaatgatagcttttactgtgagatcgcaatgctagtgtagctactaatcaaggcgctccgaacaagttcaggaacattattgaatattttgcagtgatattaaaatacttatagagaaatgtttaccatgttgcagggaaaatgatgcaaaactaagta

SEQ ID NO: 1321 - DNA, 200 bp, Commelina diffusa
tttaactctgggtagatattttttcttctctcaactatatcttgaaaatttgtgcgataaattcctaacatgattattgcttggcattgatgcagatggactcgtctagtagagctgatcttgtcaaagaaatcaaagatatccttggttgatcaatttgaccttatatatggtgcaccgcaacaaattaatgtgatgaa

SEQ ID NO: 1322 - DNA, 200 bp, Commelina diffusa
ttcatcacattaatttgttgcggtgcaccatatataaggtcaaattgatcaaccaaggatatctttgatttctttgacaagatcagctctactagacgagtccatctgcatcaatgccaagcaataatcatgttaggaatttatcgcacaaattttcaagatatagttgagagaagaaaaaatatctacccagagttaaa

SEQ ID NO: 1323 - DNA, 200 bp, Commelina diffusa
caccgcaacaaattaatgtgatgaacatcccagtaatgccttctcaagacgttgaacgcaagccagtatattatatcttttttttccccgacagagtatctacagctcctaccaatttcaggatatttaatcatatttttccttgcgtagttcatatagaaacgacattacttcagttcacctgtagataagttgaatgt

SEQ ID NO: 1324 - DNA, 200 bp, Commelina diffusa
acattcaacttatctacaggtgaactgaagtaatgtcgtttctatatgaactacgcaaggaaaaatatgattaaatatcctgaaattggtaggagctgtagatactctgtcggggaaaaaaaagatataatatactggcttgcgttcaacgtcttgagaaggcattactgggatgttcatcacattaatttgttgcggtg

SEQ ID NO: 1325 - DNA, 200 bp, Commelina diffusa
gttcacctgtagataagttgaatgttgtcattcaagcaggatgtagcagtccacaacatttgtattttttatatttcgagattcagctgtaaggaataatggctgtattattttctctaggaatgaagagtacactttattgcccaataaaagaaagaaatgtcagggattgtttcaatggaattccaaactgatctcaa

SEQ ID NO: 1326 - DNA, 200 bp, Commelina diffusa
ttgagatcagtttggaattccattgaaacaatccctgacatttctttcttttattgggcaataaagtgtactcttcattcctagagaaaataatacagccattattccttacagctgaatctcgaaatataaaaaatacaaatgttgtggactgctacatcctgcttgaatgacaacattcaacttatctacaggtgaac

SEQ ID NO: 1327 - DNA, 200 bp, Commelina diffusa
caatggaattccaaactgatctcaactacattaggcgtggttaaaaaaaaactacactacgtctgttgccaaatatagaaaagtatttttaggaatatttaggctttgtttgggaaacataatgacttaatacaataattgtgtaaacacaagtaattaattactatatttggataacactttataatacaaagtctctc

SEQ ID NO: 1328 - DNA, 200 bp, Commelina diffusa
gagagactttgtattataaagtgttatccaaatatagtaattaattacttgtgtttacacaattattgtattaagtcattatgtttcccaaacaaagcctaaatattcctaaaaatacttttctatatttggcaacagacgtagtgtagtttttttttaaccacgcctaatgtagttgagatcagtttggaattccattg

SEQ ID NO: 1329 - DNA, 200 bp, Commelina diffusa
aacactttataatacaaagtctctcactacaaatgtaatgtttattatctcataggagcaaaaaaaaaaaaaaactcttaggaggtcgtgtgtaaatgtaatgtttattatctcataggaggtcgtattcattacacagacatataatcccatcataagatatctctcatgtttactaaaaattttcattttaaaattta

SEQ ID NO: 1330 - DNA, 200 bp, Commelina diffusa
taaattttaaaatgaaaatttttagtaaacatgagagatatcttatgatgggattatatgtctgtgtaatgaatacgacctcctatgagataataaacattacatttacacacgacctcctaagagtttttttttttttttgctcctatgagataataaacattacatttgtagtgagagactttgtattataaagtgtt

SEQ ID NO: 1331 - DNA, 200 bp, Commelina diffusa
ctaaaaattttcattttaaaatttaaacataaatgttattactaataatatatacattctttatttattatttttattatattacacgtattttagccaatgttgtaagtcactacattacaaattttgtaaatgatttaattacgttgcaaatcattttatccttcccaaataaggcagaatcactttgtcatttcatg

SEQ ID NO: 1332 - DNA, 200 bp, Commelina diffusa
catgaaatgacaaagtgattctgccttatttgggaaggataaaatgatttgcaacgtaattaaatcatttacaaaatttgtaatgtagtgacttacaacattggctaaaatacgtgtaatataataaaaataataaataaagaatgtatatattattagtaataacatttatgtttaaattttaaaatgaaaatttttag

SEQ ID NO: 1333 - DNA, 200 bp, Commelina diffusa
ggcagaatcactttgtcatttcatgtgattaaaaaaataagaggtcagagataattacttggacttgatattatagtaattttgcatgatatcttacccattctatgatatttaaacactcatatttggacgtcatgggatcctatggaataatggaaataactcaatgctcatgaactgggcaaaaacaattagctctt

SEQ ID NO: 1334 - DNA, 200 bp, Commelina diffusa
aagagctaattgtttttgcccagttcatgagcattgagttatttccattattccataggatcccatgacgtccaaatatgagtgtttaaatatcatagaatgggtaagatatcatgcaaaattactataatatcaagtccaagtaattatctctgacctcttatttttttaatcacatgaaatgacaaagtgattctgcc

SEQ ID NO: 1335 - DNA, 200 bp, Commelina diffusa
aactgggcaaaaacaattagctcttaccttttctttttttcccctaacaagatgattctatgatgtaaataactttactgatttttttttatttgcttaacacactctcaatctatatggtaatgggctaaaatcttttgctcatgagattcaaatatttctcgcgagatttcgttattgccaaacaggtctgttctttt

SEQ ID NO: 1336 - DNA, 200 bp, Commelina diffusa
aaaagaacagacctgtttggcaataacgaaatctcgcgagaaatatttgaatctcatgagcaaaagattttagcccattaccatatagattgagagtgtgttaagcaaataaaaaaaaatcagtaaagttatttacatcatagaatcatcttgttaggggaaaaaaagaaaaggtaagagctaattgtttttgcccagtt

SEQ ID NO: 1337 - DNA, 200 bp, Commelina diffusa
tattgccaaacaggtctgttcttttgtagttacttaaataatcataaactttagataagaccaacttaatttaagttaatcaacatcatcaactgaatattaactttactaacacaatgtccgtaatggcatgttttgctcacttgaaataaaaaattaaaaagaatatataagtagcattcgaaaattaatactacgtc

SEQ ID NO: 1338 - DNA, 200 bp, Commelina diffusa
gacgtagtattaattttcgaatgctacttatatattctttttaattttttatttcaagtgagcaaaacatgccattacggacattgtgttagtaaagttaatattcagttgatgatgttgattaacttaaattaagttggtcttatctaaagtttatgattatttaagtaactacaaaagaacagacctgtttggcaata

SEQ ID NO: 1339 - DNA, 200 bp, Commelina diffusa
agcattcgaaaattaatactacgtccaattagagttaacattatgacaacaatacgacaatatccaaattaccatctttgctcctctgtctccaaaaactaatgttattcatctcgctgcccccaaccattgaaccaattgatattctaaccttaatcaatcaattctcccactctcactgacaactggactctgacctc

SEQ ID NO: 1340 - DNA, 200 bp, Commelina diffusa
gaggtcagagtccagttgtcagtgagagtgggagaattgattgattaaggttagaatatcaattggttcaatggttgggggcagcgagatgaataacattagtttttggagacagaggagcaaagatggtaatttggatattgtcgtattgttgtcataatgttaactctaattggacgtagtattaattttcgaatgct

SEQ ID NO: 1341 - DNA, 200 bp, Commelina diffusa
tcactgacaactggactctgacctcagttggtggcacctccgtcgtgggcttcttcactccttacaactctaataactcctagcttaattttcagtacaaaatcacagtccaaaatgttgtatggatagcaaacaaagttaaacccataatccaagggcagaataacaaactcaagcgaatcggagaagagcaggaccga

SEQ ID NO: 1342 - DNA, 200 bp, Commelina diffusa
tcggtcctgctcttctccgattcgcttgagtttgttattctgcccttggattatgggtttaactttgtttgctatccatacaacattttggactgtgattttgtactgaaaattaagctaggagttattagagttgtaaggagtgaagaagcccacgacggaggtgccaccaactgaggtcagagtccagttgtcagtga

SEQ ID NO: 1343 - DNA, 200 bp, Commelina diffusa
gcgaatcggagaagagcaggaccgagcacgagatctggtcgactgagcttgagtgggccaagcttaagcttgcgatggagaagaagtgcgccagagaagaggggcacacctggataaggaaggcgagatacacgagcatgaccaaatcgaaaatgagctggaggggaagggaggaggagaataagggagacatgagagga

SEQ ID NO: 1344 - DNA, 200 bp, Commelina diffusa
tcctctcatgtctcccttattctcctcctcccttcccctccagctcattttcgatttggtcatgctcgtgtatctcgccttccttatccaggtgtgcccctcttctctggcgcacttcttctccatcgcaagcttaagcttggcccactcaagctcagtcgaccagatctcgtgctcggtcctgctcttctccgattcgc

SEQ ID NO: 1345 - DNA, 200 bp, Commelina diffusa
atgacactgattaaatatctatgtagaacgcctgaagcccagaagggagcagttatggcagatgtctggcaagatcatgggattttaaatgggacagttcaagtcaaacatgcagctacaacgtctgaagttgatgatttctgttatgcacttggtggaaagagacctattcgcagcatattgattgctaataatggaat

SEQ ID NO: 1346 - DNA, 200 bp, Commelina diffusa
attccattattagcaatcaatatgctgcgaataggtctctttccaccaagtgcataacagaaatcatcaacttcagacgttgtagctgcatgtttgacttgaactgtcccatttaaaatcccatgatcttgccagacatctgccataactgctcccttctgggcttcaggcgttctacatagatatttaatcagtgtcat

SEQ ID NO: 1347 - DNA, 200 bp, Commelina diffusa
gcatattgattgctaataatggaatggctgctgtcaaattcatgcgtagtattagaacctgggcttacgaaacatttggatcagaaaaggcaattttgttggttgcgatggcaactccagaagacttgaggataaatgccgagcacattagaattgctgatcaatttgtagaggttcccggtggaaccaataataacaat

SEQ ID NO: 1348 - DNA, 200 bp, Commelina diffusa
attgttattattggttccaccgggaacctctacaaattgatcagcaattctaatgtgctcggcatttatcctcaagtcttctggagttgccatcgcaaccaacaaaattgccttttctgatccaaatgtttcgtaagcccaggttctaatactacgcatgaatttgacagcagccattccattattagcaatcaatatgc

SEQ ID NO: 1349 - DNA, 200 bp, Commelina diffusa
tcccggtggaaccaataataacaattatgcaaatgttcaactcattgtggagctggccgaaataacacgtgtttctgcagtttggcctggatggggccatgcatccgagaatcccgaacttccagatgccctgaatgcaaagggaataatctttctcgggcctccagctgcgccaatgtcagcactaggtgataaaattg

SEQ ID NO: 1350 - DNA, 200 bp, Commelina diffusa
caattttatcacctagtgctgacattggcgcagctggaggcccgagaaagattattccctttgcattcagggcatctggaagttcgggattctcggatgcatggccccatccaggccaaactgcagaaacacgtgttatttcggccagctccacaatgagttgaacatttgcataattgttattattggttccaccggga

SEQ ID NO: 1351 - DNA, 200 bp, Commelina diffusa
atgtcagcactaggtgataaaattggttcttctctaattgctcaggcagcaggtgtaccaactcttccgtggagtggctcacatgtcaaaatttcagcggaaagttgtatggacacaatacccgaagagatatacaagcaggcttgtgtttatacaacagaagaagcagtggccagctgccaggtagttggctatcctgc

SEQ ID NO: 1352 - DNA, 200 bp, Commelina diffusa
gcaggatagccaactacctggcagctggccactgcttcttctgttgtataaacacaagcctgcttgtatatctcttcgggtattgtgtccatacaactttccgctgaaattttgacatgtgagccactccacggaagagttggtacacctgctgcctgagcaattagagaagaaccaattttatcacctagtgctgacat

SEQ ID NO: 1353 - DNA, 200 bp, Commelina diffusa
gctgccaggtagttggctatcctgccatgataaaggcatcttggggcggtggtggtaaaggaataagaaaggttcacaatgacgatgaagtgagagctctcttcaaacaagtgcaaggagaagttccaggatctccaatatttataatgaaagtggcatcacagagtcgtcacttggaagttcagttgctttgtgatgaa

SEQ ID NO: 1354 - DNA, 200 bp, Commelina diffusa
ttcatcacaaagcaactgaacttccaagtgacgactctgtgatgccactttcattataaatattggagatcctggaacttctccttgcacttgtttgaagagagctctcacttcatcgtcattgtgaacctttcttattcctttaccaccaccgccccaagatgcctttatcatggcaggatagccaactacctggcagc

SEQ ID NO: 1355 - DNA, 200 bp, Commelina diffusa
ggaagttcagttgctttgtgatgaatatggcaatgttgctgctcttcacagtcgagattgcagtgttcaaaggcgacaccaaaagatcatcgaagaaggtccgatcacggtggcccctcctgagacagtcaaacaacttgagcaggcagcaagaaggcttgctaagtgtgttggttatgttggtgctgctactgttgaat

SEQ ID NO: 1356 - DNA, 200 bp, Commelina diffusa
attcaacagtagcagcaccaacataaccaacacacttagcaagccttcttgctgcctgctcaagttgtttgactgtctcaggaggggccaccgtgatcggaccttcttcgatgatcttttggtgtcgcctttgaacactgcaatctcgactgtgaagagcagcaacattgccatattcatcacaaagcaactgaacttcc

SEQ ID NO: 1357 - DNA, 200 bp, Commelina diffusa
tatgttggtgctgctactgttgaatatctctacagtatggaaactggtgactactatttcctagaactgaaccctcgattacaggttgagcatcctgtaactgagtggatagctgaagtcagcttgcctgcggctcaagtttcagttggtatgggcataccactatggcaaattccagaaatcagaagattttatggaaa

SEQ ID NO: 1358 - DNA, 200 bp, Commelina diffusa
tttccataaaatcttctgatttctggaatttgccatagtggtatgcccataccaactgaaacttgagccgcaggcaagctgacttcagctatccactcagttacaggatgctcaacctgtaatcgagggttcagttctaggaaatagtagtcaccagtttccatactgtagagatattcaacagtagcagcaccaacata

SEQ ID NO: 1359 - DNA, 200 bp, Commelina diffusa
cagaaatcagaagattttatggaaaggagcatggtggaggatatgatgcttggaggaagacatcactttctgcaagtccttttgactttgacaaagcagagtctacaaggccaagaggtcattgtgtagctgttcgtgtgacgagtgaagatccagatgatggcttcaagcccaccagtggcaaagtgcaggagctaaat

SEQ ID NO: 1360 - DNA, 200 bp, Commelina diffusa
atttagctcctgcactttgccactggtgggcttgaagccatcatctggatcttcactcgtcacacgaacagctacacaatgacctcttggccttgtagactctgctttgtcaaagtcaaaaggacttgcagaaagtgatgtcttcctccaagcatcatatcctccaccatgctcctttccataaaatcttctgatttctg

SEQ ID NO: 1361 - DNA, 200 bp, Commelina diffusa
cagtggcaaagtgcaggagctaaattttaaaagcaagcctaatgtgtgggcatacttctctgttaagtctggtggtggcatccatgaattttctgattctcaatttggacatgtttttgcatttggggaatctagagccttggcgatagctaacatggttcttggactgaaggagatccaaattcgtggggaaattcgaa

SEQ ID NO: 1362 - DNA, 200 bp, Commelina diffusa
ttcgaatttccccacgaatttggatctccttcagtccaagaaccatgttagctatcgccaaggctctagattccccaaatgcaaaaacatgtccaaattgagaatcagaaaattcatggatgccaccaccagacttaacagagaagtatgcccacacattaggcttgcttttaaaatttagctcctgcactttgccactg

SEQ ID NO: 1363 - DNA, 200 bp, Commelina diffusa
atccaaattcgtggggaaattcgaacaaatgttgattacacaattgatctattaaatgcatcagaatacagagacaacaaaatccacactggttggctggatagcagaatagcaatgagggtcagagctgagaggcctccatggtacctttcagttgttggaggagctctttataaagcaacaactagcagtgctgccat

SEQ ID NO: 1364 - DNA, 200 bp, Commelina diffusa
atggcagcactgctagttgttgctttataaagagctcctccaacaactgaaaggtaccatggaggcctctcagctctgaccctcattgctattctgctatccagccaaccagtgtggattttgttgtctctgtattctgatgcatttaatagatcaattgtgtaatcaacatttgttcgaatttccccacgaatttggat

SEQ ID NO: 1365 - DNA, 200 bp, Commelina diffusa
aagcaacaactagcagtgctgccattgtttccgaatatgttggttatcttggtaaaggtcaaatcccaccaaagattgaaatggttcgaggtggacctggtagttataaattaaaaatgaatggttcagagattgaagctgaaattcatactctccgtgatggtggacttctgatgcagctagtttcagtggcaaagcaa

SEQ ID NO: 1366 - DNA, 200 bp, Commelina diffusa
ttgctttgccactgaaactagctgcatcagaagtccaccatcacggagagtatgaatttcagcttcaatctctgaaccattcatttttaatttataactaccaggtccacctcgaaccatttcaatctttggtgggatttgacctttaccaagataaccaacatattcggaaacaatggcagcactgctagttgttgctt

SEQ ID NO: 1367 - DNA, 200 bp, Commelina diffusa
gcagctagtttcagtggcaaagcaagcattccaatatgctaagcctgttaacagtattgatgctgctgtaaaattgccccgtatgaatttccagtcttcttcatactctatttttcttaataagataatgtaccgacaacttgatgatggaagctttttggatggaaacagccatgtgatatatgctgaagaggaggctg

SEQ ID NO: 1368 - DNA, 200 bp, Commelina diffusa
cagcctcctcttcagcatatatcacatggctgtttccatccaaaaagcttccatcatcaagttgtcggtacattatcttattaagaaaaatagagtatgaagaagactggaaattcatacggggcaattttacagcagcatcaatactgttaacaggcttagcatattggaatgcttgctttgccactgaaactagctgc

SEQ ID NO: 1369 - DNA, 200 bp, Commelina diffusa
gtgatatatgctgaagaggaggctgctggtacacgccttcttatcgatggaaggacttgcttgttacagaatgatcatgatccatcgaaattgattgcggagacaccatgcaaacttcttcgctacttgattgctgatggagagcatcttgatgctgatgcaccatatgcagaggtcgaagtaatgaagatgtgcatgcc

SEQ ID NO: 1370 - DNA, 200 bp, Commelina diffusa
ggcatgcacatcttcattacttcgacctctgcatatggtgcatcagcatcaagatgctctccatcagcaatcaagtagcgaagaagtttgcatggtgtctccgcaatcaatttcgatggatcatgatcattctgtaacaagcaagtccttccatcgataagaaggcgtgtaccagcagcctcctcttcagcatatatcac

SEQ ID NO: 1371 - DNA, 200 bp, Commelina diffusa
tcgaagtaatgaagatgtgcatgccccttttgttacctgcttctggagttattcattttgtgatgtctgaaggtcaggctatgcaggctggtgacctcatagcaaggctcgacttagacgatccatctgctgtaagaagagctgaaccattcaatggtacattccctaaagtaggtcctcccactgcagtttctgacaga

SEQ ID NO: 1372 - DNA, 200 bp, Commelina diffusa
tctgtcagaaactgcagtgggaggacctactttagggaatgtaccattgaatggttcagctcttcttacagcagatggatcgtctaagtcgagccttgctatgaggtcaccagcctgcatagcctgaccttcagacatcacaaaatgaataactccagaagcaggtaacaaaaggggcatgcacatcttcattacttcga

SEQ ID NO: 1373 - DNA, 200 bp, Commelina diffusa
tcctcccactgcagtttctgacagagttcaccagagatgtgctgcaagtttgaatgctgcacgcatgattcttgcaggatatgaacataatattaatgaagttgttcaagagttactacattgtttggatagtccggagcttccttttctacagtggcaggaaagtatgtctgtattggcaactcgcctgccgaaagaac

SEQ ID NO: 1374 - DNA, 200 bp, Commelina diffusa
gttctttcggcaggcgagttgccaatacagacatactttcctgccactgtagaaaaggaagctccggactatccaaacaatgtagtaactcttgaacaacttcattaatattatgttcatatcctgcaagaatcatgcgtgcagcattcaaacttgcagcacatctctggtgaactctgtcagaaactgcagtgggagga

SEQ ID NO: 1375 - DNA, 200 bp, Commelina diffusa
ttggcaactcgcctgccgaaagaacttaaaaatgagttggattctaaatacaaagtatttgaaacaaactcaaacgttcaaaagaatgtggaatttcctgccaagcttctgagtggagttattgagagctatctctcatcttgtagtgagaaagataaggcggcacaggaaaggcttgtggaaccacttctgagccttgc

SEQ ID NO: 1376 - DNA, 200 bp, Commelina diffusa
gcaaggctcagaagtggttccacaagcctttcctgtgccgccttatctttctcactacaagatgagagatagctctcaataactccactcagaagcttggcaggaaattccacattcttttgaacgtttgagtttgtttcaaatactttgtatttagaatccaactcatttttaagttctttcggcaggcgagttgccaa

SEQ ID NO: 1377 - DNA, 200 bp, Commelina diffusa
ttgtggaaccacttctgagccttgcgaagtcatacgaaggtggaagagaaagccatgctcgtgtaattgtgcattctctttttgaagagtacttatctgttgaagagttattcagtgatagcattcaggccgatgtcatagaacgcctacgacttcaataccagaaggatcttctgaaagttgtagacatagtgctgtct

SEQ ID NO: 1378 - DNA, 200 bp, Commelina diffusa
agacagcactatgtctacaactttcagaagatccttctggtattgaagtcgtaggcgttctatgacatcggcctgaatgctatcactgaataactcttcaacagataagtactcttcaaaaagagaatgcacaattacacgagcatggctttctcttccaccttcgtatgacttcgcaaggctcagaagtggttccacaa

SEQ ID NO: 1379 - DNA, 200 bp, Commelina diffusa
gaaagttgtagacatagtgctgtctcatcagggtgttagaagtaaaaataagctgatactgaggttgatggaagcattggtctatcctaatcctgctgcctatcgggaacaactgattcgcttctctgctcttaaccataccacttactccgagttagcattgaaagccagtcaactccttgaacaaactaaattgagtg

SEQ ID NO: 1380 - DNA, 200 bp, Commelina diffusa
cactcaatttagtttgttcaaggagttgactggctttcaatgctaactcggagtaagtggtatggttaagagcagagaagcgaatcagttgttcccgataggcagcaggattaggatagaccaatgcttccatcaacctcagtatcagcttatttttacttctaacaccctgatgagacagcactatgtctacaactttc

SEQ ID NO: 1381 - DNA, 200 bp, Commelina diffusa
ctccttgaacaaactaaattgagtgagcttcgaacaagcattgccagaagcctttccgagctagaaatgtttacagaagaaggtgaacgtctatctacaccgagaaggaaaagtgctatcaatgagaggatggaggatcttgtaagtgctacgctggccgttgaagatgcacttgtgtctttgtttgatcacactgatcc

SEQ ID NO: 1382 - DNA, 200 bp, Commelina diffusa
ggatcagtgtgatcaaacaaagacacaagtgcatcttcaacggccagcgtagcacttacaagatcctccatcctctcattgatagcacttttccttctcggtgtagatagacgttcaccttcttctgtaaacatttctagctcggaaaggcttctggcaatgcttgttcgaagctcactcaatttagtttgttcaaggag

SEQ ID NO: 1383 - DNA, 200 bp, Commelina diffusa
tgtctttgtttgatcacactgatccaactgttcagagacgagtgatggaaacatatgtccgaagattgtaccagccctaccttgtgaaggatagtgtccgaatgcagtggcaccgttctggtttgatcgcgacatgggaattcaccgaagaacatattgagaaaaagaatgattcttctacacaagataagtcatttatg

SEQ ID NO: 1384 - DNA, 200 bp, Commelina diffusa
cataaatgacttatcttgtgtagaagaatcattctttttctcaatatgttcttcggtgaattcccatgtcgcgatcaaaccagaacggtgccactgcattcggacactatccttcacaaggtagggctggtacaatcttcggacatatgtttccatcactcgtctctgaacagttggatcagtgtgatcaaacaaagaca

SEQ ID NO: 1385 - DNA, 200 bp, Commelina diffusa
ttctacacaagataagtcatttatggagaaacattgtcaaaagagatggggagctatggttatcgtcaaatctctccagtttcttccagcagcaattagtgcagcattgaaggaaaccagtcatctgtcatctgatactgatcatgatacagtatctaatgggcttcctcaacatgctagtcaaggcaatatgcttcatg

SEQ ID NO: 1386 - DNA, 200 bp, Commelina diffusa
catgaagcatattgccttgactagcatgttgaggaagcccattagatactgtatcatgatcagtatcagatgacagatgactggtttccttcaatgctgcactaattgctgctggaagaaactggagagatttgacgataaccatagctccccatctcttttgacaatgtttctccataaatgacttatcttgtgtagaa

SEQ ID NO: 1387 - DNA, 200 bp, Commelina diffusa
gctagtcaaggcaatatgcttcatgttgcattggttggcattaacaatcaaatgagtacacttcaggatagtggagatgaggatcaggctcaggagaggatacacaagcttgccaagattctaaaagataacaaggtagcgactgaactttccaatgctggagtccgagttgttagctgtattatacaaagagatgaagg

SEQ ID NO: 1388 - DNA, 200 bp, Commelina diffusa
ccttcatctctttgtataatacagctaacaactcggactccagcattggaaagttcagtcgctaccttgttatcttttagaatcttggcaagcttgtgtatcctctcctgagcctgatcctcatctccactatcctgaagtgtactcatttgattgttaatgccaaccaatgcaacatgaagcatattgccttgactagc

SEQ ID NO: 1389 - DNA, 200 bp, Commelina diffusa
gctgtattatacaaagagatgaaggacgaacacctatgcgtcactccttccattggtctgccgataagcaatgctatgaagaagaacccttgcttcgtcatctggaacctcctctgtctactttccttgaattggataagctgaaaggctacaaaaatatacaatacacaccatcacgggatcgccagtggcatatgtac

SEQ ID NO: 1390 - DNA, 200 bp, Commelina diffusa
gtacatatgccactggcgatcccgtgatggtgtgtattgtatatttttgtagcctttcagcttatccaattcaaggaaagtagacagaggaggttccagatgacgaagcaagggttcttcttcatagcattgcttatcggcagaccaatggaaggagtgacgcataggtgttcgtccttcatctctttgtataatacagc

SEQ ID NO: 1391 - DNA, 200 bp, Commelina diffusa
acgggatcgccagtggcatatgtacacagttcaagaaactaaaccacttaatcagaggatgtttctgaggacccttgtcagacaaccaaggataaataatggattttcatcaaaccagcttcccgaattagaaactagacatgatttatcctttacatcagtcagcttgttgagatctttgatggcagcattggaagagt

SEQ ID NO: 1392 - DNA, 200 bp, Commelina diffusa
actcttccaatgctgccatcaaagatctcaacaagctgactgatgtaaaggataaatcatgtctagtttctaattcgggaagctggtttgatgaaaatccattatttatccttggttgtctgacaagggtcctcagaaacatcctctgattaagtggtttagtttcttgaactgtgtacatatgccactggcgatcccgt

SEQ ID NO: 1393 - DNA, 200 bp, Commelina diffusa
tctttgatggcagcattggaagagttagaactacatgtccatagcgaaacaatcagatctgatcattctcacatgtatctctgcatattacaagaacaacaactctccgatcttttacctcgttcaggtactcttgatcctgatgcctatcagaatgaaagtcaagtgtccctgcttttaaaagatatggctgtcaggat

SEQ ID NO: 1394 - DNA, 200 bp, Commelina diffusa
atcctgacagccatatcttttaaaagcagggacacttgactttcattctgataggcatcaggatcaagagtacctgaacgaggtaaaagatcggagagttgttgttcttgtaatatgcagagatacatgtgagaatgatcagatctgattgtttcgctatggacatgtagttctaactcttccaatgctgccatcaaaga

SEQ ID NO: 1395 - DNA, 200 bp, Commelina diffusa
ttttaaaagatatggctgtcaggattcatgagatagttggtgtaaggatgcatcgtcttactgttattgagtgggaggtaaagctctggttgggttctgatggtgttgctggtggttcttggagggttgtggtgacaaatgttactggacgtacatgtaatgtccatatttaccgagaattggaggacagcaaatcacat

SEQ ID NO: 1396 - DNA, 200 bp, Commelina diffusa
atgtgatttgctgtcctccaattctcggtaaatatggacattacatgtacgtccagtaacatttgtcaccacaaccctccaagaaccaccagcaacaccatcagaacccaaccagagctttacctcccactcaataacagtaagacgatgcatccttacaccaactatctcatgaatcctgacagccatatcttttaaaa

SEQ ID NO: 1397 - DNA, 200 bp, Commelina diffusa
agaattggaggacagcaaatcacatgaagtggtctatcactctgcagcttcagtcacaggacctctccatggtatgccgttgattgctagatatcagccacttagtgttattgataaaaaacgatgggtggcaagaaggagcaacactacttattgctatgactttccactggcgtttgagacagcactgaagcagtcat

SEQ ID NO: 1398 - DNA, 200 bp, Commelina diffusa
atgactgcttcagtgctgtctcaaacgccagtggaaagtcatagcaataagtagtgttgctccttcttgccacccatcgttttttatcaataacactaagtggctgatatctagcaatcaacggcataccatggagaggtcctgtgactgaagctgcagagtgatagaccacttcatgtgatttgctgtcctccaattct

SEQ ID NO: 1399 - DNA, 200 bp, Commelina diffusa
tttgagacagcactgaagcagtcatgggcttcttatagtgatactaaagcaccagaaagcaaagctcttctccaagttcaagaacttatgtttgttgacaaaaagggatcatggggtactcctgttgaacctgtatgctgcccacctggtctcagtgatattggcatggttgcttggtcaatggaaatgtacacaccaga

SEQ ID NO: 1400 - DNA, 200 bp, Commelina diffusa
tctggtgtgtacatttccattgaccaagcaaccatgccaatatcactgagaccaggtgggcagcatacaggttcaacaggagtaccccatgatccctttttgtcaacaaacataagttcttgaacttggagaagagctttgctttctggtgctttagtatcactataagaagcccatgactgcttcagtgctgtctcaaa

SEQ ID NO: 1401 - DNA, 200 bp, Commelina diffusa
ggtcaatggaaatgtacacaccagaatttcccgaaggaaggaagattgttgttgtagccaatgatttgactttcaaagcaggctcctttgggcctcgtgaagatgcatttttccatgctgtaaccaattatgcatgtgataagaggctccctctaatctatttggcagcaaattctggcgccaggattggtgctgctgaa

SEQ ID NO: 1402 - DNA, 200 bp, Commelina diffusa
ttcagcagcaccaatcctggcgccagaatttgctgccaaatagattagagggagcctcttatcacatgcataattggttacagcatggaaaaatgcatcttcacgaggcccaaaggagcctgctttgaaagtcaaatcattggctacaacaacaatcttccttccttcgggaaattctggtgtgtacatttccattgacc

SEQ ID NO: 1403 - DNA, 200 bp, Commelina diffusa
tggcgccaggattggtgctgctgaagaggtcaagtcttgctttaaggttggatggtctgatgagtcgagtccagaacgtggttttcagtatgtgtatctgacacaggaggactataaccgtattggttcatctgttattgcacatgaactgaagcttgaaagtggtgagatcagatgggtgatcgacacaattgttggca

SEQ ID NO: 1404 - DNA, 200 bp, Commelina diffusa
tgccaacaattgtgtcgatcacccatctgatctcaccactttcaagcttcagttcatgtgcaataacagatgaaccaatacggttatagtcctcctgtgtcagatacacatactgaaaaccacgttctggactcgactcatcagaccatccaaccttaaagcaagacttgacctcttcagcagcaccaatcctggcgcca

SEQ ID NO: 1405 - DNA, 200 bp, Commelina diffusa
tgggtgatcgacacaattgttggcaaagatgatgacttgggtgttgagaacctcactggcagtggtgcaattgccggtgcttattccagggcttataacgaggtatttactcttacatatgtgactggacgtactgtaggaatcggagcctatcttgctcggcttggcatgaggtgtatccagaggctagaccagcctat

SEQ ID NO: 1406 - DNA, 200 bp, Commelina diffusa
ataggctggtctagcctctggatacacctcatgccaagccgagcaagataggctccgattcctacagtacgtccagtcacatatgtaagagtaaatacctcgttataagccctggaataagcaccggcaattgcaccactgccagtgaggttctcaacacccaagtcatcatctttgccaacaattgtgtcgatcaccca

SEQ ID NO: 1407 - DNA, 200 bp, Commelina diffusa
gtatccagaggctagaccagcctataatcctaacagggttttctacactcaacaagttgcttggccgtgaggtgtacagctcacacatgcaactaggtggcccgaagatcatggctacaaatggtgttgttcatctgacggtatcagatgatcttgagggcgtttctgctattcttaagtggcttagttacgtaccaccc

SEQ ID NO: 1408 - DNA, 200 bp, Commelina diffusa
gggtggtacgtaactaagccacttaagaatagcagaaacgccctcaagatcatctgataccgtcagatgaacaacaccatttgtagccatgatcttcgggccacctagttgcatgtgtgagctgtacacctcacggccaagcaacttgttgagtgtagaaaaccctgttaggattataggctggtctagcctctggatac

SEQ ID NO: 1409 - DNA, 200 bp, Commelina diffusa
taagtggcttagttacgtaccaccctatgtcggtgggccacttccaataataaaatccttggatcccccagaaaggccagtggagtattttcctgaaaattcatgtgatccacgggccgcaatttgcggcattgatgatggcaatggcaagtggttaggtggtatgtttgataaagatagttttacggagacattagaag

SEQ ID NO: 1410 - DNA, 200 bp, Commelina diffusa
cttctaatgtctccgtaaaactatctttatcaaacataccacctaaccacttgccattgccatcatcaatgccgcaaattgcggcccgtggatcacatgaattttcaggaaaatactccactggcctttctgggggatccaaggattttattattggaagtggcccaccgacatagggtggtacgtaactaagccactta

SEQ ID NO: 1411 - DNA, 200 bp, Commelina diffusa
gatagttttacggagacattagaaggttgggcaaagacggtggtcaccggaagagcaaagttgggtggaattccagtaggagttatagctgtcgagacacagactgtgatgcaagtcattcctgcagatcctggtcagcttgattcccatgaacgtgttgtcccacaagctggtcaagtttggttccctgattctgccac

SEQ ID NO: 1412 - DNA, 200 bp, Commelina diffusa
gtggcagaatcagggaaccaaacttgaccagcttgtgggacaacacgttcatgggaatcaagctgaccaggatctgcaggaatgacttgcatcacagtctgtgtctcgacagctataactcctactggaattccacccaactttgctcttccggtgaccaccgtctttgcccaaccttctaatgtctccgtaaaactatc

SEQ ID NO: 1413 - DNA, 200 bp, Commelina diffusa
aagtttggttccctgattctgccaccaaaacggcacaagcattattagacttcaatcgtgaagaattgccacttttcatactagccaactggagaggattctcaggcggacagagagatctcttcgaaggtatacttcaggctggttccacaatcgtcgaaaacttaaggacatataagcagcctgtatttacctacatc

SEQ ID NO: 1414 - DNA, 200 bp, Commelina diffusa
gatgtaggtaaatacaggctgcttatatgtccttaagttttcgacgattgtggaaccagcctgaagtataccttcgaagagatctctctgtccgcctgagaatcctctccagttggctagtatgaaaagtggcaattcttcacgattgaagtctaataatgcttgtgccgttttggtggcagaatcagggaaccaaactt

SEQ ID NO: 1415 - DNA, 200 bp, Commelina diffusa
taagcagcctgtatttacctacatcccaatggccggggagcttcgtggtggtgcatgggttgtggtggacagcaaaatcaacccggatcacatcgagatgtatgccgaaagaacagcaaggggcaacgtacttgagcccgaaggaatgattgagattaagttcagaactaaagaacttctcgagtgcatgggtagacttg

SEQ ID NO: 1416 - DNA, 200 bp, Commelina diffusa
caagtctacccatgcactcgagaagttctttagttctgaacttaatctcaatcattccttcgggctcaagtacgttgccccttgctgttctttcggcatacatctcgatgtgatccgggttgattttgctgtccaccacaacccatgcaccaccacgaagctccccggccattgggatgtaggtaaatacaggctgctta

SEQ ID NO: 1417 - DNA, 200 bp, Commelina diffusa
cttctcgagtgcatgggtagacttgatcctgagctaatcagtttgaaaacaaagcttagggagttgaaggcagctggaccttccagagatgtggacgtcctccagaaaagtgtaacggctagagagaagcagttattgcctgtatatacacaaattgctataaagtttgcagagttgcacgatacatccttgcgaatggc

SEQ ID NO: 1418 - DNA, 200 bp, Commelina diffusa
gccattcgcaaggatgtatcgtgcaactctgcaaactttatagcaatttgtgtatatacaggcaataactgcttctctctagccgttacacttttctggaggacgtccacatctctggaaggtccagctgccttcaactccctaagctttgttttcaaactgattagctcaggatcaagtctacccatgcactcgagaag

SEQ ID NO: 1419 - DNA, 200 bp, Commelina diffusa
tgcacgatacatccttgcgaatggctgccaaaggtgtgatcaagaaagtggtagactgggagaactcccgttctttcttctacaaaaggttaaacaggagagtttccgaggatgtccttgcaaaaactgttagagatgctgctggggagcagttgtcgtacaagtctgctattgaactgcttaagcagtggttttcatct

SEQ ID NO: 1420 - DNA, 200 bp, Commelina diffusa
agatgaaaaccactgcttaagcagttcaatagcagacttgtacgacaactgctccccagcagcatctctaacagtttttgcaaggacatcctcggaaactctcctgtttaaccttttgtagaagaaagaacgggagttctcccagtctaccactttcttgatcacacctttggcagccattcgcaaggatgtatcgtgca

SEQ ID NO: 1421 - DNA, 200 bp, Commelina diffusa
actgcttaagcagtggttttcatcttccgacaatgtggacgttggaaaatgggaggaagacgatgctttccttgcctggaaagacaaccctaaaaattatgccaagtatcttgaagagctacgagttcagaagatattgcagcagctctcagctcttggtgaatcatcttcggatttgcgagtattgcctcaatgtcttg

SEQ ID NO: 1422 - DNA, 200 bp, Commelina diffusa
caagacattgaggcaatactcgcaaatccgaagatgattcaccaagagctgagagctgctgcaatatcttctgaactcgtagctcttcaagatacttggcataatttttagggttgtctttccaggcaaggaaagcatcgtcttcctcccattttccaacgtccacattgtcggaagatgaaaaccactgcttaagcagt

SEQ ID NO: 1423 - DNA, 200 bp, Commelina diffusa
ttgcgagtattgcctcaatgtcttgctacagtccttagcaagggcagaataacaaactcaagcgaatcggagaagagcaggaccgagcacgagatctggtcgactgagcttgagtgggccaagcttaagcttgcgatggagaagaagtgcgccagagaagaggggcacacctggataaggaaggcgagatacacgagcat

SEQ ID NO: 1424 - DNA, 200 bp, Commelina diffusa
atgctcgtgtatctcgccttccttatccaggtgtgcccctcttctctggcgcacttcttctccatcgcaagcttaagcttggcccactcaagctcagtcgaccagatctcgtgctcggtcctgctcttctccgattcgcttgagtttgttattctgcccttgctaaggactgtagcaagacattgaggcaatactcgcaa

SEQ ID NO: 1425 - DNA, 200 bp, Commelina diffusa
caagtaattattatataattttcaccctattccattttatttatttttaatttattgactataaaagttacataatactgtactttatttttgtttacttttattgaagaaaaaacagcccttctctcccctcacaaataaattaaaaacaattaatttccaatattagagaaccaaaagtaattccccttaatgacaat

SEQ ID NO: 1426 - DNA, 200 bp, Commelina diffusa
attgtcattaaggggaattacttttggttctctaatattggaaattaattgtttttaatttatttgtgaggggagagaagggctgttttttcttcaataaaagtaaacaaaaataaagtacagtattatgtaacttttatagtcaataaattaaaaataaataaaatggaatagggtgaaaattatataataattacttg

SEQ ID NO: 1427 - DNA, 200 bp, Commelina diffusa
aaaagtaattccccttaatgacaatttaaaagaaagaaataaatacaaccaacctctaaatcacacacatattcatatatttatacaaataaaataaatagagggagagagtagttggccatcagccccacctaacaaaaacaagtctagagtcaaaattgggacacgaagatgtcatcttcattgtaaaatcaaatgtt

SEQ ID NO: 1428 - DNA, 200 bp, Commelina diffusa
aacatttgattttacaatgaagatgacatcttcgtgtcccaattttgactctagacttgtttttgttaggtggggctgatggccaactactctctccctctatttattttatttgtataaatatatgaatatgtgtgtgatttagaggttggttgtatttatttctttcttttaaattgtcattaaggggaattactttt

SEQ ID NO: 1429 - DNA, 200 bp, Commelina diffusa
catcttcattgtaaaatcaaatgttaattaaaccccaaaaataaaatgtaagcacaagatgtttgaacaagcactttgattcccaattttcacctcaggggatcaaaaaggcaccatcttgacaattatatatacacacactctatacaacattgttgtggtggtagttggcagctgtggctctgaatttcaattccttt

SEQ ID NO: 1430 - DNA, 200 bp, Commelina diffusa
aaaggaattgaaattcagagccacagctgccaactaccaccacaacaatgttgtatagagtgtgtgtatatataattgtcaagatggtgcctttttgatcccctgaggtgaaaattgggaatcaaagtgcttgttcaaacatcttgtgcttacattttatttttggggtttaattaacatttgattttacaatgaagatg

SEQ ID NO: 1431 - DNA, 200 bp, Commelina diffusa
tgtggctctgaatttcaattcctttgtttgcccttcaattccctgttgctgttgttggtgaggagaaaggaagctggcgtcacgtggtgctgctgtccataccatttaaggccctcgccgtctccccaccccattggtgcccttttccccctttttaaatactgcttttttggtgatttggtgaatggtgtggtgaggag

SEQ ID NO: 1432 - DNA, 200 bp, Commelina diffusa
ctcctcaccacaccattcaccaaatcaccaaaaaagcagtatttaaaaagggggaaaagggcaccaatggggtggggagacggcgagggccttaaatggtatggacagcagcaccacgtgacgccagcttcctttctcctcaccaacaacagcaacagggaattgaagggcaaacaaaggaattgaaattcagagccaca

SEQ ID NO: 1433 - DNA, 200 bp, Commelina diffusa
atttggtgaatggtgtggtgaggagtcgtcaaaatcccgcctttttgctgggattgtgctcgtcttagctcccctgagctgttggttgtgtaaaggtgcgatcttggtgcgttttgttgggtgaattcgagctctttgtcgctgtttagggttcaagattgcgctttttttttttttgcccttgttagtgttggtagttg

SEQ ID NO: 1434 - DNA, 200 bp, Commelina diffusa
caactaccaacactaacaagggcaaaaaaaaaaaaagcgcaatcttgaaccctaaacagcgacaaagagctcgaattcacccaacaaaacgcaccaagatcgcacctttacacaaccaacagctcaggggagctaagacgagcacaatcccagcaaaaaggcgggattttgacgactcctcaccacaccattcaccaaat

SEQ ID NO: 1435 - DNA, 200 bp, Commelina diffusa
ttgcccttgttagtgttggtagttgttagtccaccggctgattgaattgtagctctttggcactgtttgtgtgagtgatctgctttgcatcaggggactacaaatttcattttagtagtgttatgctggaattttggttctgctgattgggttattgcgcctgtgttattttgtcttgtgcgtcttaaattctgtctgta

SEQ ID NO: 1436 - DNA, 200 bp, Commelina diffusa
tacagacagaatttaagacgcacaagacaaaataacacaggcgcaataacccaatcagcagaaccaaaattccagcataacactactaaaatgaaatttgtagtcccctgatgcaaagcagatcactcacacaaacagtgccaaagagctacaattcaatcagccggtggactaacaactaccaacactaacaagggcaa

SEQ ID NO: 1437 - DNA, 200 bp, Commelina diffusa
ttgtgcgtcttaaattctgtctgtagtttagtgttgtaacgagtgcttctcgcttctagactttgtttgtatcttctgtgtcttgattattgttactattattattttattttatttttggttagtgagtcaacctatggggttagtaataagacattgtttcagttagttatgtgaattggtaactcttaatctcgttt

SEQ ID NO: 1438 - DNA, 200 bp, Commelina diffusa
aaacgagattaagagttaccaattcacataactaactgaaacaatgtcttattactaaccccataggttgactcactaaccaaaaataaaataaaataataatagtaacaataatcaagacacagaagatacaaacaaagtctagaagcgagaagcactcgttacaacactaaactacagacagaatttaagacgcacaa

SEQ ID NO: 1439 - DNA, 200 bp, Commelina diffusa
gaattggtaactcttaatctcgtttagaagattggtgagttagtttttacctggttctgtacattcgaatagcttttactgttgatttgctgcatttttaccaaattctttgtcgcttttttggtgtaaagcaagaatgagaaaaatgatacttgattgaattatgggttcccaaaccaagtaataatttgggaattgct

SEQ ID NO: 1440 - DNA, 200 bp, Commelina diffusa
agcaattcccaaattattacttggtttgggaacccataattcaatcaagtatcatttttctcattcttgctttacaccaaaaaagcgacaaagaatttggtaaaaatgcagcaaatcaacagtaaaagctattcgaatgtacagaaccaggtaaaaactaactcaccaatcttctaaacgagattaagagttaccaattc

SEQ ID NO: 1441 - DNA, 200 bp, Commelina diffusa
accaagtaataatttgggaattgctttctgataactctttattggtggagctttggtactaggatatatatgtatatatatgattatatcatatggatagcaactgggtagttgttcagttagaatcttggtcgttaaaagaaaaaagaatgaattgaatattcatttatttgagcctatgaggataatttgttaactga

SEQ ID NO: 1442 - DNA, 200 bp, Commelina diffusa
tcagttaacaaattatcctcataggctcaaataaatgaatattcaattcattcttttttcttttaacgaccaagattctaactgaacaactacccagttgctatccatatgatataatcatatatatacatatatatcctagtaccaaagctccaccaataaagagttatcagaaagcaattcccaaattattacttggt

SEQ ID NO: 1443 - DNA, 200 bp, Commelina diffusa
cctatgaggataatttgttaactgaaaatggttttgttcgagtggtagggatgtctaaggagccatgtagttcgtttagtttgttattctattttcattcttataaagaaatttaatttatcatgaaagcattgggaccagttgtataaatagttctcctttttactgcaaatggcagttacataaagaatctattacaa

SEQ ID NO: 1444 - DNA, 200 bp, Commelina diffusa
ttgtaatagattctttatgtaactgccatttgcagtaaaaaggagaactatttatacaactggtcccaatgctttcatgataaattaaatttctttataagaatgaaaatagaataacaaactaaacgaactacatggctccttagacatccctaccactcgaacaaaaccattttcagttaacaaattatcctcatagg

SEQ ID NO: 1445 - DNA, 200 bp, Commelina diffusa
cagttacataaagaatctattacaagaatatgcttattaggagctggtttatattttcagtttgcactttttctgtgtttactaaagaaacaagttattcttgtgcctttcttacctgacgtcagagaatgatattttcttgaaagtcaaatgttgcttattatatatcccgtcactttgcgtgtatattgatgacactg

SEQ ID NO: 1446 - DNA, 200 bp, Commelina diffusa
cagtgtcatcaatatacacgcaaagtgacgggatatataataagcaacatttgactttcaagaaaatatcattctctgacgtcaggtaagaaaggcacaagaataacttgtttctttagtaaacacagaaaaagtgcaaactgaaaatataaaccagctcctaataagcatattcttgtaatagattctttatgtaactg

SEQ ID NO: 1447 - DNA, 200 bp, Commelina diffusa
ctttgcgtgtatattgatgacactgattaaatatctatgtagaacgcctgaagcccagaagggagcagttatggcagatgtctggcaagatcatgggattttaaatgggacagttcaagtcaaacatgcagctacaacgtctgaagttgatgatttctgttatgcacttggtggaaagagacctattcgcagcatattga

SEQ ID NO: 1448 - DNA, 200 bp, Commelina diffusa
tcaatatgctgcgaataggtctctttccaccaagtgcataacagaaatcatcaacttcagacgttgtagctgcatgtttgacttgaactgtcccatttaaaatcccatgatcttgccagacatctgccataactgctcccttctgggcttcaggcgttctacatagatatttaatcagtgtcatcaatatacacgcaaag

SEQ ID NO: 1449 - DNA, 200 bp, Commelina diffusa
aagagacctattcgcagcatattgattgctaataatggaatggctgctgtcaaattcatgcgtagtattagaacctgggcttacgaaacatttggatcagaaaaggcaattttgttggttgcgatggcaactccagaagacttgaggataaatgccgagcacattagaattgctgatcaatttgtagaggttcccggtgg

SEQ ID NO: 1450 - DNA, 200 bp, Commelina diffusa
ccaccgggaacctctacaaattgatcagcaattctaatgtgctcggcatttatcctcaagtcttctggagttgccatcgcaaccaacaaaattgccttttctgatccaaatgtttcgtaagcccaggttctaatactacgcatgaatttgacagcagccattccattattagcaatcaatatgctgcgaataggtctctt

SEQ ID NO: 1451 - DNA, 200 bp, Commelina diffusa
atcaatttgtagaggttcccggtggaaccaataataacaattatgcaaatgttcaactcattgtggaggtcagttttgcttactttttggctgacattactttgattgagcattttgattgtttcttttcttgtttgtgctgattttgacaacacactttgtgacagctggccgaaataacacgtgtttctgcagtttgg

SEQ ID NO: 1452 - DNA, 200 bp, Commelina diffusa
ccaaactgcagaaacacgtgttatttcggccagctgtcacaaagtgtgttgtcaaaatcagcacaaacaagaaaagaaacaatcaaaatgctcaatcaaagtaatgtcagccaaaaagtaagcaaaactgacctccacaatgagttgaacatttgcataattgttattattggttccaccgggaacctctacaaattgat

SEQ ID NO: 1453 - DNA, 200 bp, Commelina diffusa
aataacacgtgtttctgcagtttggcctggatggggccatgcatccgagaatcccgaacttccagatgccctgaatgcaaagggaataatctttctcgggcctccagctgcgccaatgtcagcactaggtgataaaattggttcttctctaattgctcaggcagcaggtgtaccaactcttccgtggagtggctcacatg

SEQ ID NO: 1454 - DNA, 200 bp, Commelina diffusa
catgtgagccactccacggaagagttggtacacctgctgcctgagcaattagagaagaaccaattttatcacctagtgctgacattggcgcagctggaggcccgagaaagattattccctttgcattcagggcatctggaagttcgggattctcggatgcatggccccatccaggccaaactgcagaaacacgtgttatt

SEQ ID NO: 1455 - DNA, 200 bp, Commelina diffusa
actcttccgtggagtggctcacatgtaatcttacttgctaatttgcaaatacattatttcatatttctcattctttcaccaaaatttacatgtgaaattatcttttaggtcaaaatttcagcggaaagttgtatggacacaatacccgaagagatatacaagcaggcttgtgtttatacaacagaagaagcagtggccag

SEQ ID NO: 1456 - DNA, 200 bp, Commelina diffusa
ctggccactgcttcttctgttgtataaacacaagcctgcttgtatatctcttcgggtattgtgtccatacaactttccgctgaaattttgacctaaaagataatttcacatgtaaattttggtgaaagaatgagaaatatgaaataatgtatttgcaaattagcaagtaagattacatgtgagccactccacggaagagt

SEQ ID NO: 1457 - DNA, 200 bp, Commelina diffusa
atacaacagaagaagcagtggccagctgccaggtagttggctatcctgccatgataaaggcatcttggggcggtggtggtaaaggaataagaaaggtatagcataaaaataatcagtagtagttcttttattctctccaacaatgcttacagaaagggtggcaaatagattagtgcaatgcctgtggctatatatgccaa

SEQ ID NO: 1458 - DNA, 200 bp, Commelina diffusa
ttggcatatatagccacaggcattgcactaatctatttgccaccctttctgtaagcattgttggagagaataaaagaactactactgattatttttatgctatacctttcttattcctttaccaccaccgccccaagatgcctttatcatggcaggatagccaactacctggcagctggccactgcttcttctgttgtat

SEQ ID NO: 1459 - DNA, 200 bp, Commelina diffusa
caatgcctgtggctatatatgccaaagaaggtagagaaacgctgaaacggatattgtttcttaatatttttgaggttatgatcttattttggtgttcagtcaactcctgaagtccaacaaataatgatgtagccatatgtattatctaaacatgattcatttgtttattcatggttgtcattacaaatggaattacagta

SEQ ID NO: 1460 - DNA, 200 bp, Commelina diffusa
tactgtaattccatttgtaatgacaaccatgaataaacaaatgaatcatgtttagataatacatatggctacatcattatttgttggacttcaggagttgactgaacaccaaaataagatcataacctcaaaaatattaagaaacaatatccgtttcagcgtttctctaccttctttggcatatatagccacaggcattg

SEQ ID NO: 1461 - DNA, 200 bp, Conyza canadensis
agtagagtctagattaaaatttcatatacgattgatattataaagtgaataatagtagccttgacgagtcaaagagatatcacagagagatattagaatccggacattactaacggcataggattaacggaatttgtggttttaaaacagtaattatctaagaaatatgaaacaagaagttatatattcgaataaacttg

SEQ ID NO: 1462 - DNA, 200 bp, Conyza canadensis
caagtttattcgaatatataacttcttgtttcatatttcttagataattactgttttaaaaccacaaattccgttaatcctatgccgttagtaatgtccggattctaatatctctctgtgatatctctttgactcgtcaaggctactattattcactttataatatcaatcgtatatgaaattttaatctagactctact

SEQ ID NO: 1463 - DNA, 200 bp, Conyza canadensis
gaagttatatattcgaataaacttggatacaataatttgattacatgttagttcaaccataatcaaatactcgaaagtcgtaatacactaccaatatcttgattcatatcatttgcattgactaaatcactaaaatcatcattaaattacaacaaaaatattatgtattggactattgggggtggggtggggtagggtag

SEQ ID NO: 1464 - DNA, 200 bp, Conyza canadensis
ctaccctaccccaccccacccccaatagtccaatacataatatttttgttgtaatttaatgatgattttagtgatttagtcaatgcaaatgatatgaatcaagatattggtagtgtattacgactttcgagtatttgattatggttgaactaacatgtaatcaaattattgtatccaagtttattcgaatatataacttc

SEQ ID NO: 1465 - DNA, 200 bp, Conyza canadensis
ttgggggtggggtggggtagggtagggtagggggtttggttacccatctcacgtggcatgcatcacctctcatattatatgcaggcatactaaacaaaccaaatacccaacaaaaaacacccatatttcagcaattccaactttcttgcaacaacgttattattatttttatcttgtaaattcttgattgattcaactgc

SEQ ID NO: 1466 - DNA, 200 bp, Conyza canadensis
gcagttgaatcaatcaagaatttacaagataaaaataataataacgttgttgcaagaaagttggaattgctgaaatatgggtgttttttgttgggtatttggtttgtttagtatgcctgcatataatatgagaggtgatgcatgccacgtgagatgggtaaccaaaccccctaccctaccctaccccaccccacccccaa

SEQ ID NO: 1467 - DNA, 200 bp, Conyza canadensis
gtaaattcttgattgattcaactgcttttccacttgttcatggttagtctttctcattctttatattttgaaaaaaagatgatttttagtgattaaagattgaatcttttttctaagtttatgtcatttcttgaaatttttgtgcttctagaattgggtttactgtgttatatgaatttaataagtaaaaaagatgattt

SEQ ID NO: 1468 - DNA, 200 bp, Conyza canadensis
aaatcatcttttttacttattaaattcatataacacagtaaacccaattctagaagcacaaaaatttcaagaaatgacataaacttagaaaaaagattcaatctttaatcactaaaaatcatctttttttcaaaatataaagaatgagaaagactaaccatgaacaagtggaaaagcagttgaatcaatcaagaatttac

SEQ ID NO: 1469 - DNA, 200 bp, Conyza canadensis
atttaataagtaaaaaagatgattttagtgattaaagactgaatcttttttctaagtttatgtcatttcttgaaattcttgtgcttcttgaactgggtttactgtgttatatgaatttaacaagtaaaaaagatgattttagtgattaaagattgaattattttactgggtgtaatgtcatttcttaaaattcttgtgtt

SEQ ID NO: 1470 - DNA, 200 bp, Conyza canadensis
aacacaagaattttaagaaatgacattacacccagtaaaataattcaatctttaatcactaaaatcatcttttttacttgttaaattcatataacacagtaaacccagttcaagaagcacaagaatttcaagaaatgacataaacttagaaaaaagattcagtctttaatcactaaaatcatcttttttacttattaaat

SEQ ID NO: 1471 - DNA, 200 bp, Conyza canadensis
tgtcatttcttaaaattcttgtgtttcttgaattattatgaatttaagtagtaagtatacaaaagatgatttactggggtaaaggttgaatcattttactgggtgttatgtcattttgtgaaatacttgtgatttttgaattgggtttactgggttttatgaattcaagtagtagtgcaaaaaaatgatgaagagggtgt

SEQ ID NO: 1472 - DNA, 200 bp, Conyza canadensis
acaccctcttcatcatttttttgcactactacttgaattcataaaacccagtaaacccaattcaaaaatcacaagtatttcacaaaatgacataacacccagtaaaatgattcaacctttaccccagtaaatcatcttttgtatacttactacttaaattcataataattcaagaaacacaagaattttaagaaatgaca

SEQ ID NO: 1473 - DNA, 200 bp, Conyza canadensis
tgcaaaaaaatgatgaagagggtgttggaaagattaactcattactgaatttaggaaagccaaataatgagagattagtgtttggcagaacaaatgaattttctgggtcttgaacatagtttgaaaaagcatgctgggacatgtttttccaaaaatgctattttgtaaacaaaatttcaaactcctcctttgcagttaaa

SEQ ID NO: 1474 - DNA, 200 bp, Conyza canadensis
tttaactgcaaaggaggagtttgaaattttgtttacaaaatagcatttttggaaaaacatgtcccagcatgctttttcaaactatgttcaagacccagaaaattcatttgttctgccaaacactaatctctcattatttggctttcctaaattcagtaatgagttaatctttccaacaccctcttcatcatttttttgca

SEQ ID NO: 1475 - DNA, 200 bp, Conyza canadensis
ttcaaactcctcctttgcagttaaagattgaatctttcttaccgggtatatgtcgtttcttgaaattcgtgtctttcttgaattgggtttactgtttaacgattaaactttgagactttttactatgtttatgttaatttctttctctcaatgttgtgatttgactttggaatgctgtctaattaactatagttttgttg

SEQ ID NO: 1476 - DNA, 200 bp, Conyza canadensis
caacaaaactatagttaattagacagcattccaaagtcaaatcacaacattgagagaaagaaattaacataaacatagtaaaaagtctcaaagtttaatcgttaaacagtaaacccaattcaagaaagacacgaatttcaagaaacgacatatacccggtaagaaagattcaatctttaactgcaaaggaggagtttgaa

SEQ ID NO: 1477 - DNA, 200 bp, Conyza canadensis
tgtctaattaactatagttttgttgattttgacattttttttggcatatgggtatgcatcttaggaggatcttttatgtgttttgttgggttacatttgtttgataagattttggattaatcaagtggacatgatgaaactttatgtgatgaaataatataaaaatcccaatatagaattaaacacagaattaaaaagta

SEQ ID NO: 1478 - DNA, 200 bp, Conyza canadensis
tactttttaattctgtgtttaattctatattgggatttttatattatttcatcacataaagtttcatcatgtccacttgattaatccaaaatcttatcaaacaaatgtaacccaacaaaacacataaaagatcctcctaagatgcatacccatatgccaaaaaaaatgtcaaaatcaacaaaactatagttaattagaca

SEQ ID NO: 1479 - DNA, 200 bp, Conyza canadensis
gaattaaacacagaattaaaaagtagatatgatgcgcacattccgcctttttgatcccacaagtaacttttagattggatcactgactataaaatattccacatcattctataaaaaatcagaattctggattataaaatacacattggtatccattttttgaagcaccaaagtttgatccctttgtgatacttcatatt

SEQ ID NO: 1480 - DNA, 200 bp, Conyza canadensis
aatatgaagtatcacaaagggatcaaactttggtgcttcaaaaaatggataccaatgtgtattttataatccagaattctgattttttatagaatgatgtggaatattttatagtcagtgatccaatctaaaagttacttgtgggatcaaaaaggcggaatgtgcgcatcatatctactttttaattctgtgtttaattc

SEQ ID NO: 1481 - DNA, 200 bp, Conyza canadensis
tgatccctttgtgatacttcatattcagtttcacgtggttattaatttattatctgaaattgtaattttcatttgaattcgcctgtttgatttacaaaatttgagttgcaagttctgtttttatcccccttaagtttgcttcaagaaaatagttaagattattaaagaagaaaaaacccagttgtttgaccatttaggaa

SEQ ID NO: 1482 - DNA, 200 bp, Conyza canadensis
ttcctaaatggtcaaacaactgggttttttcttctttaataatcttaactattttcttgaagcaaacttaagggggataaaaacagaacttgcaactcaaattttgtaaatcaaacaggcgaattcaaatgaaaattacaatttcagataataaattaataaccacgtgaaactgaatatgaagtatcacaaagggatca

SEQ ID NO: 1483 - DNA, 200 bp, Conyza canadensis
acccagttgtttgaccatttaggaatttaagtaatgctgaactaaactttgattggtctacttggcagtggaaccatgccagaagctcaaagaatgcctctaaatggaagccttaatcttggtaatggttatgtaaatggggccatttcattgaggtcttctgctagcagatctgccattgatgaattttgtaatgcact

SEQ ID NO: 1484 - DNA, 200 bp, Conyza canadensis
agtgcattacaaaattcatcaatggcagatctgctagcagaagacctcaatgaaatggccccatttacataaccattaccaagattaaggcttccatttagaggcattctttgagcttctggcatggttccactgccaagtagaccaatcaaagtttagttcagcattacttaaattcctaaatggtcaaacaactgggt

SEQ ID NO: 1485 - DNA, 200 bp, Conyza canadensis
ccattgatgaattttgtaatgcacttggggggaataggccaatccatagtattttaattgcaaacaatggaatggctgctgtaaagtttataagaagtgtgaggacatggagttatgaaacgtttggttcagaaaaagcaattttgttggtagccatggctacacctgaggatatgaggattaatgccgagcatattaga

SEQ ID NO: 1486 - DNA, 200 bp, Conyza canadensis
tctaatatgctcggcattaatcctcatatcctcaggtgtagccatggctaccaacaaaattgctttttctgaaccaaacgtttcataactccatgtcctcacacttcttataaactttacagcagccattccattgtttgcaattaaaatactatggattggcctattccccccaagtgcattacaaaattcatcaatgg

SEQ ID NO: 1487 - DNA, 200 bp, Conyza canadensis
gaggattaatgccgagcatattagaattgctgatcagtttgttgaagtcccaggtggtacaaataataataattatgctaatgtgcagctcatcgtggaggtaagtatggatccgacactcgtttatttacataccactaagtgactgactttatgagccgggtcatatttggctttttatcgcacatcagctgtagctg

SEQ ID NO: 1488 - DNA, 200 bp, Conyza canadensis
cagctacagctgatgtgcgataaaaagccaaatatgacccggctcataaagtcagtcacttagtggtatgtaaataaacgagtgtcggatccatacttacctccacgatgagctgcacattagcataattattattatttgtaccacctgggacttcaacaaactgatcagcaattctaatatgctcggcattaatcctc

SEQ ID NO: 1489 - DNA, 200 bp, Conyza canadensis
ttttatcgcacatcagctgtagctgttttgtatatgccgaaagaccagtatattgggtgatcactatcaattttctttagaagtttgagtttgtgtctgattatttcagactgctgagataacacatgttgatgctgtttggcctggttggggtcatgcctctgaaattcctgaattacctgatgcattggacgcaaagg

SEQ ID NO: 1490 - DNA, 200 bp, Conyza canadensis
cctttgcgtccaatgcatcaggtaattcaggaatttcagaggcatgaccccaaccaggccaaacagcatcaacatgtgttatctcagcagtctgaaataatcagacacaaactcaaacttctaaagaaaattgatagtgatcacccaatatactggtctttcggcatatacaaaacagctacagctgatgtgcgataaaa

SEQ ID NO: 1491 - DNA, 200 bp, Conyza canadensis
ttacctgatgcattggacgcaaagggaattgtatttcttgggccgccggcttcatccatggcggctttaggagacaaaatcggctcttctttaattgcacaagctgctgacgtgccaacacttccttggagtggttctcatgtaaaattttccaccattgttttattacttttaccattacagtgagcttgacacctctt

SEQ ID NO: 1492 - DNA, 200 bp, Conyza canadensis
aagaggtgtcaagctcactgtaatggtaaaagtaataaaacaatggtggaaaattttacatgagaaccactccaaggaagtgttggcacgtcagcagcttgtgcaattaaagaagagccgattttgtctcctaaagccgccatggatgaagccggcggcccaagaaatacaattccctttgcgtccaatgcatcaggtaa

SEQ ID NO: 1493 - DNA, 200 bp, Conyza canadensis
cattacagtgagcttgacacctcttatttttcaaaattggagattaatgcccctcagctataagaatttggatatttataccttctgatttccaaccaacatatctatgtgtttttgaaaatcatacgtgtatctatacctcttactcttaaataatctaatcctttttttttctttgttcaaaatcacacaaatatgtt

SEQ ID NO: 1494 - DNA, 200 bp, Conyza canadensis
aacatatttgtgtgattttgaacaaagaaaaaaaaaggattagattatttaagagtaagaggtatagatacacgtatgattttcaaaaacacatagatatgttggttggaaatcagaaggtataaatatccaaattcttatagctgaggggcattaatctccaattttgaaaaataagaggtgtcaagctcactgtaatg

SEQ ID NO: 1495 - DNA, 200 bp, Conyza canadensis
ttgttcaaaatcacacaaatatgttgctcatttgtcaaatttatatctttcaggtgaaaatttctgcagagagctgcttagacacaattccagatgacgtatatagaaaagcttgtgtccatacaaccgaggaagcagttgcttcttgtcaagttattggttatcctgctatgatcaaggcatcatggggcggtggtggc

SEQ ID NO: 1496 - DNA, 200 bp, Conyza canadensis
gccaccaccgccccatgatgccttgatcatagcaggataaccaataacttgacaagaagcaactgcttcctcggttgtatggacacaagcttttctatatacgtcatctggaattgtgtctaagcagctctctgcagaaattttcacctgaaagatataaatttgacaaatgagcaacatatttgtgtgattttgaacaa

SEQ ID NO: 1497 - DNA, 200 bp, Conyza canadensis
caaggcatcatggggcggtggtggcaaaggcataagaaaggtgtgcttccttacatttgagaataatttttatgtgaagttgtcaaaggtgtagaatgaagtgataacacattaatctgtaggtgcatagtgatgaagaagtcaagacactttttaagcaagttcagggtgaagtccctggttcccccatatttattatg

SEQ ID NO: 1498 - DNA, 200 bp, Conyza canadensis
cataataaatatgggggaaccagggacttcaccctgaacttgcttaaaaagtgtcttgacttcttcatcactatgcacctacagattaatgtgttatcacttcattctacacctttgacaacttcacataaaaattattctcaaatgtaaggaagcacacctttcttatgcctttgccaccaccgccccatgatgccttg

SEQ ID NO: 1499 - DNA, 200 bp, Conyza canadensis
ccctggttcccccatatttattatgaaagttgcttcccaggtgagaaaacattctaatatctttctaaccgtaatatgcatttatcattttttctttctaaaagcattttttgtcatttatcatttgttgtcggaaaatagagccgacatctagaagtacaactcctctgtgatcagcatggcaatgtagcggctttaca

SEQ ID NO: 1500 - DNA, 200 bp, Conyza canadensis
tgtaaagccgctacattgccatgctgatcacagaggagttgtacttctagatgtcggctctattttccgacaacaaatgataaatgacaaaaaatgcttttagaaagaaaaaatgataaatgcatattacggttagaaagatattagaatgttttctcacctgggaagcaactttcataataaatatgggggaaccaggg

SEQ ID NO: 1501 - DNA, 200 bp, Conyza canadensis
agcatggcaatgtagcggctttacatagtcgggattgcagtgttcaaaggcggcatcaaaaggttcacccaattcaattgtttaattcattttttcctttttatcttgtttttaatcttttttttttggataatttcaagattatcgaggaggggccaataaccatagccccccctgacacaataaaaaaattggagcaa

SEQ ID NO: 1502 - DNA, 200 bp, Conyza canadensis
ttgctccaatttttttattgtgtcagggggggctatggttattggcccctcctcgataatcttgaaattatccaaaaaaaaaagattaaaaacaagataaaaaggaaaaaatgaattaaacaattgaattgggtgaaccttttgatgccgcctttgaacactgcaatcccgactatgtaaagccgctacattgccatgct

SEQ ID NO: 1503 - DNA, 200 bp, Conyza canadensis
tgacacaataaaaaaattggagcaagcggcaagaagattagccaaatcggtcaattatgttggagctgcaactgtagagtatttgtacagtatggaaaccggagattattactttttggagctcaatccccgtttacaggtgcaagtgttttttttggtgctgtatattggaggacactagatgtgattcattctcagtc

SEQ ID NO: 1504 - DNA, 200 bp, Conyza canadensis
gactgagaatgaatcacatctagtgtcctccaatatacagcaccaaaaaaaacacttgcacctgtaaacggggattgagctccaaaaagtaataatctccggtttccatactgtacaaatactctacagttgcagctccaacataattgaccgatttggctaatcttcttgccgcttgctccaatttttttattgtgtca

SEQ ID NO: 1505 - DNA, 200 bp, Conyza canadensis
cactagatgtgattcattctcagtcatatctgacacctttttattaggttgagcatcctgtcactgagtggatagcggaagttaatctacctgcagcacaagttgcggttggaatgggcattccactttggcaaattcccggtaatatgtcagaataagccataaatgtaatgaacggttgacaattgttggccatcata

SEQ ID NO: 1506 - DNA, 200 bp, Conyza canadensis
tatgatggccaacaattgtcaaccgttcattacatttatggcttattctgacatattaccgggaatttgccaaagtggaatgcccattccaaccgcaacttgtgctgcaggtagattaacttccgctatccactcagtgacaggatgctcaacctaataaaaaggtgtcagatatgactgagaatgaatcacatctagtg

SEQ ID NO: 1507 - DNA, 200 bp, Conyza canadensis
cggttgacaattgttggccatcatacttgtctacctagcacttgtcattgaaatttataaaaaagacctgtctatttaggagtatcttttgaacctttttttctttgctttagaaataagacggttttatggaaaggaaaacggtggagggtatgatgcttggaggagaacatcggttcttgcaaccccatttgattttg

SEQ ID NO: 1508 - DNA, 200 bp, Conyza canadensis
caaaatcaaatggggttgcaagaaccgatgttctcctccaagcatcataccctccaccgttttcctttccataaaaccgtcttatttctaaagcaaagaaaaaaaggttcaaaagatactcctaaatagacaggtcttttttataaatttcaatgacaagtgctaggtagacaagtatgatggccaacaattgtcaaccg

SEQ ID NO: 1509 - DNA, 200 bp, Conyza canadensis
gttcttgcaaccccatttgattttgatcgcgccgagtcagttaggccgaagggtcattgtgttgctgtacgtgtaacaagtgaagatccggatgatggttttaagcccaccagtggaaaagttcaggtttttgaaaagacttatgcacccttacgaaaataccaaatattataagtattgattatatagcatactgattg

SEQ ID NO: 1510 - DNA, 200 bp, Conyza canadensis
caatcagtatgctatataatcaatacttataatatttggtattttcgtaagggtgcataagtcttttcaaaaacctgaacttttccactggtgggcttaaaaccatcatccggatcttcacttgttacacgtacagcaacacaatgacccttcggcctaactgactcggcgcgatcaaaatcaaatggggttgcaagaac

SEQ ID NO: 1511 - DNA, 200 bp, Conyza canadensis
tattgattatatagcatactgattgacaactttttaggagctaagttttaaaagcaagccaaacgtatgggcatacttttctgtcaaggtactcttgtctcccatttatagacatttatgtaactgcttgattgccaaactacatttttttacttgctaacaccttggactcttgcagtctggaggaggcattcatgaat

SEQ ID NO: 1512 - DNA, 200 bp, Conyza canadensis
attcatgaatgcctcctccagactgcaagagtccaaggtgttagcaagtaaaaaaatgtagtttggcaatcaagcagttacataaatgtctataaatgggagacaagagtaccttgacagaaaagtatgcccatacgtttggcttgcttttaaaacttagctcctaaaaagttgtcaatcagtatgctatataatcaata

SEQ ID NO: 1513 - DNA, 200 bp, Conyza canadensis
cagtctggaggaggcattcatgaattctcagattctcaattcggtaaaggccgaatcttgtttgggttctgtttaaatgtttgaatctccaattgttagcgtagttaaattttatgagaatcactgccaagatgtttttttctcattttagttttttacatacctcaggtcatgtttttgcatttggagagtcaagaaca

SEQ ID NO: 1514 - DNA, 200 bp, Conyza canadensis
tgttcttgactctccaaatgcaaaaacatgacctgaggtatgtaaaaaactaaaatgagaaaaaaacatcttggcagtgattctcataaaatttaactacgctaacaattggagattcaaacatttaaacagaacccaaacaagattcggcctttaccgaattgagaatctgagaattcatgaatgcctcctccagactg

SEQ ID NO: 1515 - DNA, 200 bp, Conyza canadensis
ttttgcatttggagagtcaagaacattggctattgcaaatatggttcttgggctaaaggaaattcaaattcgtggcgaaatgcgcactaatgttgattatacaattgatttattacatgtgagcaacttggccttcaaagttaaattcgttttgataatattcatttacttcaaataaattacattttttctttgtaatc

SEQ ID NO: 1516 - DNA, 200 bp, Conyza canadensis
gattacaaagaaaaaatgtaatttatttgaagtaaatgaatattatcaaaacgaatttaactttgaaggccaagttgctcacatgtaataaatcaattgtataatcaacattagtgcgcatttcgccacgaatttgaatttcctttagcccaagaaccatatttgcaatagccaatgttcttgactctccaaatgcaaaa

SEQ ID NO: 1517 - DNA, 200 bp, Conyza canadensis
taaattacattttttctttgtaatcttcaaaatatataaatttataaagtacacacatcacattgggcgaagaaaagtacactccataaagtttagaatttttttaaaaaaattttcattcttttttcttattcttacacttattagtgtgaactttcacattcttgatttttctttcttatttctgcacatgtaggctc

SEQ ID NO: 1518 - DNA, 200 bp, Conyza canadensis
gagcctacatgtgcagaaataagaaagaaaaatcaagaatgtgaaagttcacactaataagtgtaagaataagaaaaaagaatgaaaatttttttaaaaaaattctaaactttatggagtgtacttttcttcgcccaatgtgatgtgtgtactttataaatttatatattttgaagattacaaagaaaaaatgtaattta

SEQ ID NO: 1519 - DNA, 200 bp, Conyza canadensis
ttcttatttctgcacatgtaggctccagattatagagaaaacaaaatacacacgggttggttagatagccgaattgcgatgcgggttagagcagaaaggcctccttggtatctttcggtagtggggggagctctttacgtaagtcatttcatatcacaatgtggtttctctattacttatcatcttttgaagcacttcca

SEQ ID NO: 1520 - DNA, 200 bp, Conyza canadensis
tggaagtgcttcaaaagatgataagtaatagagaaaccacattgtgatatgaaatgacttacgtaaagagctccccccactaccgaaagataccaaggaggcctttctgctctaacccgcatcgcaattcggctatctaaccaacccgtgtgtattttgttttctctataatctggagcctacatgtgcagaaataagaa

SEQ ID NO: 1521 - DNA, 200 bp, Conyza canadensis
cttatcatcttttgaagcacttccacttaccatcggcttttgtcgacctcagaaagccgctgctagaagtgcagccatggcctctgactatgttggttatcttgaaaaggggcaaatccctccaaaggtatcatgcattccgaaatttagaacttgggttttgtttttataaaaattggttaaaagtcgttatgtttgtt

SEQ ID NO: 1522 - DNA, 200 bp, Conyza canadensis
aacaaacataacgacttttaaccaatttttataaaaacaaaacccaagttctaaatttcggaatgcatgatacctttggagggatttgccccttttcaagataaccaacatagtcagaggccatggctgcacttctagcagcggctttctgaggtcgacaaaagccgatggtaagtggaagtgcttcaaaagatgataag

SEQ ID NO: 1523 - DNA, 200 bp, Conyza canadensis
ttggttaaaagtcgttatgtttgttttacttattaatgtttcattacttgcagcatttatcactagtcaactctcaagttactttgaatattgaggggagcagatacacagtgagtaacaagatacacaagctactaggattttttttgtgtgtatattaattcatcttttctgattctcgtatttgttgttagattgat

SEQ ID NO: 1524 - DNA, 200 bp, Conyza canadensis
atcaatctaacaacaaatacgagaatcagaaaagatgaattaatatacacacaaaaaaaatcctagtagcttgtgtatcttgttactcactgtgtatctgctcccctcaatattcaaagtaacttgagagttgactagtgataaatgctgcaagtaatgaaacattaataagtaaaacaaacataacgacttttaaccaa

SEQ ID NO: 1525 - DNA, 200 bp, Conyza canadensis
ttctcgtatttgttgttagattgatatggtaaaaagaggacctggaggttatagattgaaaatgaaccaatctgagattgaagcagaaatacatactctacgtgacgggggtttattgatgcaggtatgtaattcataatgattcattttcgttttctgggtttatttagaactgtacaatgtgtatcatataaaatgca

SEQ ID NO: 1526 - DNA, 200 bp, Conyza canadensis
tgcattttatatgatacacattgtacagttctaaataaacccagaaaacgaaaatgaatcattatgaattacatacctgcatcaataaacccccgtcacgtagagtatgtatttctgcttcaatctcagattggttcattttcaatctataacctccaggtcctctttttaccatatcaatctaacaacaaatacgagaa

SEQ ID NO: 1527 - DNA, 200 bp, Conyza canadensis
tacaatgtgtatcatataaaatgcatcttaacattggggtgcatctgtgaatcaaaatgataatcactataatgttacataaattgttactatttaagaaaaatgggtataactgaatataccagaaattatgttttaccgattgataatcagttttcttgcagttagttacaaactgatagtcgtagctgaaatgggtc

SEQ ID NO: 1528 - DNA, 200 bp, Conyza canadensis
gacccatttcagctacgactatcagtttgtaactaactgcaagaaaactgattatcaatcggtaaaacataatttctggtatattcagttatacccatttttcttaaatagtaacaatttatgtaacattatagtgattatcattttgattcacagatgcaccccaatgttaagatgcattttatatgatacacattgta

SEQ ID NO: 1529 - DNA, 200 bp, Conyza canadensis
ctgatagtcgtagctgaaatgggtcacccaaacacttgaaagtgattactgcgacttgaagttgcattaattggataatcactttcaaagcgaattgttatatacaccaataacacaatgatatctaactggttgatttaatgtggtagttggatgggaatagtcatattatatatgctgaagaagaagccgctggtact

SEQ ID NO: 1530 - DNA, 200 bp, Conyza canadensis
agtaccagcggcttcttcttcagcatatataatatgactattcccatccaactaccacattaaatcaaccagttagatatcattgtgttattggtgtatataacaattcgctttgaaagtgattatccaattaatgcaacttcaagtcgcagtaatcactttcaagtgtttgggtgacccatttcagctacgactatcag

SEQ ID NO: 1531 - DNA, 200 bp, Conyza canadensis
tgctgaagaagaagccgctggtactcgtctcctcattgatggacggacatgtttgcttcaggtgccaacaactttttttgttaacttttgctgtagtggtggcaacatttactcatctatttttaaattagtcagtttgagtcatatttaagatctaaagtgtcaaacgggttaaatagaaaaaactgaaggaaactggt

SEQ ID NO: 1532 - DNA, 200 bp, Conyza canadensis
accagtttccttcagttttttctatttaacccgtttgacactttagatcttaaatatgactcaaactgactaatttaaaaatagatgagtaaatgttgccaccactacagcaaaagttaacaaaaaaagttgttggcacctgaagcaaacatgtccgtccatcaatgaggagacgagtaccagcggcttcttcttcagca

SEQ ID NO: 1533 - DNA, 200 bp, Conyza canadensis
atagaaaaaactgaaggaaactggtcaaataggcggtaagtggcctgtgtgtattcaacacacataaccttccaaattattttttgttggaaatatatcattcttatatcatattcggaggactagtttacataaataattttactttttatacaaaaagtgtttgtgttcaatccaaaatcaacccaacctgtactgta

SEQ ID NO: 1534 - DNA, 200 bp, Conyza canadensis
tacagtacaggttgggttgattttggattgaacacaaacactttttgtataaaaagtaaaattatttatgtaaactagtcctccgaatatgatataagaatgatatatttccaacaaaaaataatttggaaggttatgtgtgttgaatacacacaggccacttaccgcctatttgaccagtttccttcagttttttctat

SEQ ID NO: 1535 - DNA, 200 bp, Conyza canadensis
caaaatcaacccaacctgtactgtacaaaattacctgttttgacctgaaccagatctgttacccagcctgatgggatatctcaatttgtcacctttaccatatccttgcttgtgtggattttaagtttgcattacttctttttagaatgatcatgatccttccaagctggtggccgaaacaccatgcaaacttctaagat

SEQ ID NO: 1536 - DNA, 200 bp, Conyza canadensis
atcttagaagtttgcatggtgtttcggccaccagcttggaaggatcatgatcattctaaaaagaagtaatgcaaacttaaaatccacacaagcaaggatatggtaaaggtgacaaattgagatatcccatcaggctgggtaacagatctggttcaggtcaaaacaggtaattttgtacagtacaggttgggttgattttg

SEQ ID NO: 1537 - DNA, 200 bp, Conyza canadensis
gaaacaccatgcaaacttctaagatacttagtctcagatagtagccatgtcgatgctgacacaccttatgctgaggtggaggtaatgaagatgtgtatgccgctactttcgccggcttctggagttatacagtttaagatgtctgaaggtcaagcaatgcatgttagccctttttctctattttttattccattttcgtc

SEQ ID NO: 1538 - DNA, 200 bp, Conyza canadensis
gacgaaaatggaataaaaaatagagaaaaagggctaacatgcattgcttgaccttcagacatcttaaactgtataactccagaagccggcgaaagtagcggcatacacatcttcattacctccacctcagcataaggtgtgtcagcatcgacatggctactatctgagactaagtatcttagaagtttgcatggtgtttc

SEQ ID NO: 1539 - DNA, 200 bp, Conyza canadensis
ctctattttttattccattttcgtcttcttcaaatcatacaccgtggacccacgaaacaaagaaagtttatttatttgagctgttatgaatgacttcatttgtaggctggtgagctaatagcaaggcttgatcttgatgacccatcagcagtaagaaaagcagagcctttccatggaacttttcctcttcttgggtcttc

SEQ ID NO: 1540 - DNA, 200 bp, Conyza canadensis
gaagacccaagaagaggaaaagttccatggaaaggctctgcttttcttactgctgatgggtcatcaagatcaagccttgctattagctcaccagcctacaaatgaagtcattcataacagctcaaataaataaactttctttgtttcgtgggtccacggtgtatgatttgaagaagacgaaaatggaataaaaaatagag

SEQ ID NO: 1541 - DNA, 200 bp, Conyza canadensis
gaacttttcctcttcttgggtcttcaactgccatgtcagataaagttcatcaaaagtgtgctacaactctaagtgccgctcgaatgattcttgcaggctatgatcacgatattgatgaagtaatcttttcgccgtataaggattttacagtttcaaaaagaagttgttcttctgttaacaagtttaaccttttattgtag

SEQ ID NO: 1542 - DNA, 200 bp, Conyza canadensis
ctacaataaaaggttaaacttgttaacagaagaacaacttctttttgaaactgtaaaatccttatacggcgaaaagattacttcatcaatatcgtgatcatagcctgcaagaatcattcgagcggcacttagagttgtagcacacttttgatgaactttatctgacatggcagttgaagacccaagaagaggaaaagttc

SEQ ID NO: 1543 - DNA, 200 bp, Conyza canadensis
taacaagtttaaccttttattgtaggttgtcaaaaaccttcttcgttgtctagataatcccaagctacctttcctccagtggcaagaatgctttgcagttctagccaatcgacttcctaaagatttaaaaaacaaggcaaatttacatcttataattcttatctatttttcttttctttcaaattggaacattgaaatgt

SEQ ID NO: 1544 - DNA, 200 bp, Conyza canadensis
acatttcaatgttccaatttgaaagaaaagaaaaatagataagaattataagatgtaaatttgccttgttttttaaatctttaggaagtcgattggctagaactgcaaagcattcttgccactggaggaaaggtagcttgggattatctagacaacgaagaaggtttttgacaacctacaataaaaggttaaacttgtta

SEQ ID NO: 1545 - DNA, 200 bp, Conyza canadensis
ctttcaaattggaacattgaaatgtatttttctaattctgttatttgtatattcagttggaaacaaaatttaaggagtacgaaggaatttccacccaacaagctattgatttccccgccaaattattatggggaattcttgaagttagtttgcgattaataattttttttattatacacatacactttttcatatttaaa

SEQ ID NO: 1546 - DNA, 200 bp, Conyza canadensis
tttaaatatgaaaaagtgtatgtgtataataaaaaaaattattaatcgcaaactaacttcaagaattccccataataatttggcggggaaatcaatagcttgttgggtggaaattccttcgtactccttaaattttgtttccaactgaatatacaaataacagaattagaaaaatacatttcaatgttccaatttgaaag

SEQ ID NO: 1547 - DNA, 200 bp, Conyza canadensis
acacatacactttttcatatttaaagatgtaatatggtaatgctatctgcacagacacatcttgaattgtgctcggaaaaggaaaggggagcccaagaaaggcttgctgagccattaatgagtcttgtcaagtcctatgaaggtggcagagagagtcatgcacgtgggatcgttcatgctctttttgaagcatatttatc

SEQ ID NO: 1548 - DNA, 200 bp, Conyza canadensis
gataaatatgcttcaaaaagagcatgaacgatcccacgtgcatgactctctctgccaccttcataggacttgacaagactcattaatggctcagcaagcctttcttgggctcccctttccttttccgagcacaattcaagatgtgtctgtgcagatagcattaccatattacatctttaaatatgaaaaagtgtatgtgt

SEQ ID NO: 1549 - DNA, 200 bp, Conyza canadensis
atgctctttttgaagcatatttatctgttgaagagctatttagcgacaacattcaggtgcgtttttttctgctgtgttgatccatgttttttttttgggatttctgatcgggcatgtactaccataacagttctttctattttatctttttacactacacagcccaatttttttcaaggttaacacattcccaccttagc

SEQ ID NO: 1550 - DNA, 200 bp, Conyza canadensis
gctaaggtgggaatgtgttaaccttgaaaaaaattgggctgtgtagtgtaaaaagataaaatagaaagaactgttatggtagtacatgcccgatcagaaatcccaaaaaaaaaacatggatcaacacagcagaaaaaaacgcacctgaatgttgtcgctaaatagctcttcaacagataaatatgcttcaaaaagagcat

SEQ ID NO: 1551 - DNA, 200 bp, Conyza canadensis
aaggttaacacattcccaccttagctttaaaaacctatttacctatgaccgggtcggcaaaagttatccctttatttcaaactttgaaactggtaaaaagtcaaccaaagtgtagttattaattcattaaaccctttgaattacttttccaaaacttggattattataaaataaagtttctgggcaatagtgtttccggt

SEQ ID NO: 1552 - DNA, 200 bp, Conyza canadensis
accggaaacactattgcccagaaactttattttataataatccaagttttggaaaagtaattcaaagggtttaatgaattaataactacactttggttgactttttaccagtttcaaagtttgaaataaagggataacttttgccgacccggtcataggtaaataggtttttaaagctaaggtgggaatgtgttaacctt

SEQ ID NO: 1553 - DNA, 200 bp, Conyza canadensis
gtttctgggcaatagtgtttccggtcaaccaacctgttcaaaaaatgacatgatttgacttgtttctggacatgatataatgtttcaggctgatgtaattgaacgtcttagacaacaatacaagaaggatctgtcgagggttgttgacatcgtgatttcacatcaggtatgttaattccactgttttgtatcttccattc

SEQ ID NO: 1554 - DNA, 200 bp, Conyza canadensis
gaatggaagatacaaaacagtggaattaacatacctgatgtgaaatcacgatgtcaacaaccctcgacagatccttcttgtattgttgtctaagacgttcaattacatcagcctgaaacattatatcatgtccagaaacaagtcaaatcatgtcattttttgaacaggttggttgaccggaaacactattgcccagaaac

SEQ ID NO: 1555 - DNA, 200 bp, Conyza canadensis
ttccactgttttgtatcttccattctaattgtttaagttaacaacctattttatgtcgacacagggtgttaagactaaaaacaaactgatactacgactgatggagcatttggtttaccctaatccagccgcctatagggaaaatctgatacggttttctcaattgaaccacactagttattctgaggtcaatattgtca

SEQ ID NO: 1556 - DNA, 200 bp, Conyza canadensis
tgacaatattgacctcagaataactagtgtggttcaattgagaaaaccgtatcagattttccctataggcggctggattagggtaaaccaaatgctccatcagtcgtagtatcagtttgtttttagtcttaacaccctgtgtcgacataaaataggttgttaacttaaacaattagaatggaagatacaaaacagtggaa

SEQ ID NO: 1557 - DNA, 200 bp, Conyza canadensis
agttattctgaggtcaatattgtcatttgacatactcataccagtttgaatatttttccgaatcttttttatgctaatactagtttgtgtttctcatttcttgttaatagttagcattgaaggcaagtcagctgctagaacagactaaactgagtgaacttcgttcaagcatagctagaagtctttctgagttagagatg

SEQ ID NO: 1558 - DNA, 200 bp, Conyza canadensis
catctctaactcagaaagacttctagctatgcttgaacgaagttcactcagtttagtctgttctagcagctgacttgccttcaatgctaactattaacaagaaatgagaaacacaaactagtattagcataaaaaagattcggaaaaatattcaaactggtatgagtatgtcaaatgacaatattgacctcagaataact

SEQ ID NO: 1559 - DNA, 200 bp, Conyza canadensis
tagaagtctttctgagttagagatgtttaccgaagaaggtgagaatatagatacccctaagaggaagagtgccattgatgaaagaatggaggatattgtgagtgctcctttggcggtcgaagatgcccttgttggtctttttgatcacagtgatcacacccttcaaaggcgtgttgttgagacctatgttcgaaggctat

SEQ ID NO: 1560 - DNA, 200 bp, Conyza canadensis
atagccttcgaacataggtctcaacaacacgcctttgaagggtgtgatcactgtgatcaaaaagaccaacaagggcatcttcgaccgccaaaggagcactcacaatatcctccattctttcatcaatggcactcttcctcttaggggtatctatattctcaccttcttcggtaaacatctctaactcagaaagacttcta

SEQ ID NO: 1561 - DNA, 200 bp, Conyza canadensis
gttgagacctatgttcgaaggctatatcaggtatttttgcttctctcatataaaataattaatttgtatcacataactggagtctgcattataactgaagcaaatttcttggaatgttataaagatgaaatcatagttatagtttcaattaaaggcattattggtaacacttacattgtatgcatcattttggtagtgtg

SEQ ID NO: 1562 - DNA, 200 bp, Conyza canadensis
cacactaccaaaatgatgcatacaatgtaagtgttaccaataatgcctttaattgaaactataactatgatttcatctttataacattccaagaaatttgcttcagttataatgcagactccagttatgtgatacaaattaattattttatatgagagaagcaaaaatacctgatatagccttcgaacataggtctcaac

SEQ ID NO: 1563 - DNA, 200 bp, Conyza canadensis
ttgtatgcatcattttggtagtgtgagcagagtagtgattttcatggcaattaaaaattaaaatgctttgtttcatctcttactgaattacactgttgttcacaaaactacttaaattgattttcatctgaactttttgtgccaaataccttggtttttctatccagatttacttttgtcttttttacccaacaaggcca

SEQ ID NO: 1564 - DNA, 200 bp, Conyza canadensis
tggccttgttgggtaaaaaagacaaaagtaaatctggatagaaaaaccaaggtatttggcacaaaaagttcagatgaaaatcaatttaagtagttttgtgaacaacagtgtaattcagtaagagatgaaacaaagcattttaatttttaattgccatgaaaatcactactctgctcacactaccaaaatgatgcatacaa

SEQ ID NO: 1565 - DNA, 200 bp, Conyza canadensis
ttgtcttttttacccaacaaggccagagcaatgatcttgatttaggtacacaagattcttgtgttaaaggagtcctacatttgattaatgatcaacatatttttcaaataccacaatttatattgtaatacagggtgtgtattttgacttcagacctttttcagctatttttgtagtaggcagaaagttgttaactgaat

SEQ ID NO: 1566 - DNA, 200 bp, Conyza canadensis
attcagttaacaactttctgcctactacaaaaatagctgaaaaaggtctgaagtcaaaatacacaccctgtattacaatataaattgtggtatttgaaaaatatgttgatcattaatcaaatgtaggactcctttaacacaagaatcttgtgtacctaaatcaagatcattgctctggccttgttgggtaaaaaagacaa

SEQ ID NO: 1567 - DNA, 200 bp, Conyza canadensis
gtaggcagaaagttgttaactgaattaatataaaaatatatataaaaagtgaagaaatgtgtttgagtattgtaatgtatactctatgtttagctggctggaaatgttccactatcttgtatatgtctactacactcttcatgaattgctaaagaaaagaattttgtgatgtaaatatatattcagttatttacacttct

SEQ ID NO: 1568 - DNA, 200 bp, Conyza canadensis
agaagtgtaaataactgaatatatatttacatcacaaaattcttttctttagcaattcatgaagagtgtagtagacatatacaagatagtggaacatttccagccagctaaacatagagtatacattacaatactcaaacacatttcttcactttttatatatatttttatattaattcagttaacaactttctgcctac

SEQ ID NO: 1569 - DNA, 200 bp, Conyza canadensis
tatatattcagttatttacacttcttacgggccaaagtcacgtgaggtttactgaccactcacttcatatctgttatcagccatatctcgtgaagaggagtgttaagatgcagtggcacagatccggacttattgcttcatggcaattcatggaaggacacgctgaagctgttaatgtgtctgattatgaaactattgat

SEQ ID NO: 1570 - DNA, 200 bp, Conyza canadensis
atcaatagtttcataatcagacacattaacagcttcagcgtgtccttccatgaattgccatgaagcaataagtccggatctgtgccactgcatcttaacactcctcttcacgagatatggctgataacagatatgaagtgagtggtcagtaaacctcacgtgactttggcccgtaagaagtgtaaataactgaatatata

SEQ ID NO: 1571 - DNA, 200 bp, Conyza canadensis
tgtgtctgattatgaaactattgatacacaattggtagataagaaatggggagctatggttattattagatctcttcaatttttacctgatgtcataagtgcagctcttaaagaaactacttataaacatcatggcacaagtcaaaatggggatgccaatccaagttatcaaggttatatgatgcatattgcattggtag

SEQ ID NO: 1572 - DNA, 200 bp, Conyza canadensis
ctaccaatgcaatatgcatcatataaccttgataacttggattggcatccccattttgacttgtgccatgatgtttataagtagtttctttaagagctgcacttatgacatcaggtaaaaattgaagagatctaataataaccatagctccccatttcttatctaccaattgtgtatcaatagtttcataatcagacaca

SEQ ID NO: 1573 - DNA, 200 bp, Conyza canadensis
tatatgatgcatattgcattggtaggcatcaacaaccaaatgagtttgcttcaagacaggtatacaatgtttcatgttgatcttatgtatcgaatttgtaaaataccatttgctacaaaaagttgaaataaagcaacttattgtacccaagttgtttatgtgtactgatgctagagtgtcaaaacagacaggttggatag

SEQ ID NO: 1574 - DNA, 200 bp, Conyza canadensis
ctatccaacctgtctgttttgacactctagcatcagtacacataaacaacttgggtacaataagttgctttatttcaactttttgtagcaaatggtattttacaaattcgatacataagatcaacatgaaacattgtatacctgtcttgaagcaaactcatttggttgttgatgcctaccaatgcaatatgcatcatata

SEQ ID NO: 1575 - DNA, 200 bp, Conyza canadensis
gtgtcaaaacagacaggttggatagcatgcctaaactgatttgggtcaaaacgggccagattaaatctgctcccatttgtattaaaatctttctattttacaagtacttaatgtaatattggatgcttacaacgactatattatatcctttattaacttttagcttagtacaaacatacatataatattccctgtattaa

SEQ ID NO: 1576 - DNA, 200 bp, Conyza canadensis
ttaatacagggaatattatatgtatgtttgtactaagctaaaagttaataaaggatataatatagtcgttgtaagcatccaatattacattaagtacttgtaaaatagaaagattttaatacaaatgggagcagatttaatctggcccgttttgacccaaatcagtttaggcatgctatccaacctgtctgttttgacac

SEQ ID NO: 1577 - DNA, 200 bp, Conyza canadensis
atacatataatattccctgtattaactcttagctaagtacttaatgtattttggatgcttacaacaactatcatattacctgtttgacctgttatcaactaagtacaaacatacatataaatggctgtgataactaggtgaccaaccttaaattaccaaaaaggtacttgttgtatttttcatcaaactaaccatctcat

SEQ ID NO: 1578 - DNA, 200 bp, Conyza canadensis
atgagatggttagtttgatgaaaaatacaacaagtacctttttggtaatttaaggttggtcacctagttatcacagccatttatatgtatgtttgtacttagttgataacaggtcaaacaggtaatatgatagttgttgtaagcatccaaaatacattaagtacttagctaagagttaatacagggaatattatatgtat

SEQ ID NO: 1579 - DNA, 200 bp, Conyza canadensis
tttttcatcaaactaaccatctcatgacattatgtcattatgatatgccatggtatagggataaaaatggaaaaatgggcctagtatcaggccatgatatttgccatgtttaccaaaggataagtttgatggatataatttttttttccccgatgatctgaaattaatggacatgttatctttttaactgcagtggtgat

SEQ ID NO: 1580 - DNA, 200 bp, Conyza canadensis
atcaccactgcagttaaaaagataacatgtccattaatttcagatcatcggggaaaaaaaaattatatccatcaaacttatcctttggtaaacatggcaaatatcatggcctgatactaggcccatttttccatttttatccctataccatggcatatcataatgacataatgtcatgagatggttagtttgatgaaaaa

SEQ ID NO: 1581 - DNA, 200 bp, Conyza canadensis
ttatctttttaactgcagtggtgatgaggatcaggctcaagagagagtcaacaagttagcaaaaatactcaaagataaagaaataagtgtgaaactaaaaaatgcaggatatgaagttgtaagttgcataatacaaagagacgaaggtagaggcccggtgagacactcatttcactggtcagaaaagaatcgttattata

SEQ ID NO: 1582 - DNA, 200 bp, Conyza canadensis
tataataacgattcttttctgaccagtgaaatgagtgtctcaccgggcctctaccttcgtctctttgtattatgcaacttacaacttcatatcctgcattttttagtttcacacttatttctttatctttgagtatttttgctaacttgttgactctctcttgagcctgatcctcatcaccactgcagttaaaaagataa

SEQ ID NO: 1583 - DNA, 200 bp, Conyza canadensis
tggtcagaaaagaatcgttattatatcgaagagccatcattgcgtcatttggagcctccattatcgatttatcttgaactggtttgtactcttaacacgcctgaatacgttcttgataacgaaagaacaataattcataaatgtattatttgtttaggacaagcttaagggctatgagaatgtaaagtacactccatcac

SEQ ID NO: 1584 - DNA, 200 bp, Conyza canadensis
gtgatggagtgtactttacattctcatagcccttaagcttgtcctaaacaaataatacatttatgaattattgttctttcgttatcaagaacgtattcaggcgtgttaagagtacaaaccagttcaagataaatcgataatggaggctccaaatgacgcaatgatggctcttcgatataataacgattcttttctgacca

SEQ ID NO: 1585 - DNA, 200 bp, Conyza canadensis
gagaatgtaaagtacactccatcacgtgaccgtcaatggcacatgtatactgttgatgctaaaccacttccggttcaaagaatgtttcttagaacgcttgtaaggcacccgacaaaagaatggttcttgccctcaggataccaagattcggaagttgtggacccacggtctcagttaactttaccttttacatcaaggag

SEQ ID NO: 1586 - DNA, 200 bp, Conyza canadensis
ctccttgatgtaaaaggtaaagttaactgagaccgtgggtccacaacttccgaatcttggtatcctgagggcaagaaccattcttttgtcgggtgccttacaagcgttctaagaaacattctttgaaccggaagtggtttagcatcaacagtatacatgtgccattgacggtcacgtgatggagtgtactttacattctc

SEQ ID NO: 1587 - DNA, 200 bp, Conyza canadensis
taactttaccttttacatcaaggagcatcttgagatctttagtgaccgccatggaggagttggaacttcatgttcataatgctatagtcaagtcggaccatgctcatatgtacctctatatattgaaagaacaacaaataaatgatcttgttccatatactaagtaagcattgccatcctctttctgagacattatatat

SEQ ID NO: 1588 - DNA, 200 bp, Conyza canadensis
atatataatgtctcagaaagaggatggcaatgcttacttagtatatggaacaagatcatttatttgttgttctttcaatatatagaggtacatatgagcatggtccgacttgactatagcattatgaacatgaagttccaactcctccatggcggtcactaaagatctcaagatgctccttgatgtaaaaggtaaagtta

SEQ ID NO: 1589 - DNA, 200 bp, Conyza canadensis
atcctctttctgagacattatatatgtatggataatattataatttcacaagttgtaaacaggagagtggatgtagattctggtaaagaagaaggtgtggttgagacgcttttggtgaagttggtccgtgaacttcattcgatggttggggtaaagatgcaccggttaggtgtttttgagtgggaggtgaagctttgtat

SEQ ID NO: 1590 - DNA, 200 bp, Conyza canadensis
atacaaagcttcacctcccactcaaaaacacctaaccggtgcatctttaccccaaccatcgaatgaagttcacggaccaacttcaccaaaagcgtctcaaccacaccttcttctttaccagaatctacatccactctcctgtttacaacttgtgaaattataatattatccatacatatataatgtctcagaaagaggat

SEQ ID NO: 1591 - DNA, 200 bp, Conyza canadensis
ttgagtgggaggtgaagctttgtatggtatcatctggtgaagccaacggtgtttggagggtggtggtcacaaatgtgactgggcatacctgcaatgtacatgtaagtcattaaacggactttttagacatttgaccatactcgatatcttttacctacaatgaatttttgaaatttgtatataggtgtatcgggaagtag

SEQ ID NO: 1592 - DNA, 200 bp, Conyza canadensis
ctacttcccgatacacctatatacaaatttcaaaaattcattgtaggtaaaagatatcgagtatggtcaaatgtctaaaaagtccgtttaatgacttacatgtacattgcaggtatgcccagtcacatttgtgaccaccaccctccaaacaccgttggcttcaccagatgataccatacaaagcttcacctcccactcaa

SEQ ID NO: 1593 - DNA, 200 bp, Conyza canadensis
tgtatataggtgtatcgggaagtagaagatactgttaaacacaaggcagtgtatcatgctccctctacattgggacctttacatggtgtgctggtgaacacaccctttcagcctctgggattactcgatcagaagcgtcttgtcgccaggaaaagcaatactacttactgctacgactttgcactggtaaaatccccgtt

SEQ ID NO: 1594 - DNA, 200 bp, Conyza canadensis
aacggggattttaccagtgcaaagtcgtagcagtaagtagtattgcttttcctggcgacaagacgcttctgatcgagtaatcccagaggctgaaagggtgtgttcaccagcacaccatgtaaaggtcccaatgtagagggagcatgatacactgccttgtgtttaacagtatcttctacttcccgatacacctatataca

SEQ ID NO: 1595 - DNA, 200 bp, Conyza canadensis
actttgcactggtaaaatccccgttcttcccttttaagtcagatatgcatttgctatactattttttacaaagtactggttcttattgatcatacttgtatgtgcaggcatttgaagcagcccttgagaatatctggtcatcaaaactgcctggtgtaagcaggcccaagggcaaacttgtaaatgcgatggagcttgtg

SEQ ID NO: 1596 - DNA, 200 bp, Conyza canadensis
cacaagctccatcgcatttacaagtttgcccttgggcctgcttacaccaggcagttttgatgaccagatattctcaagggctgcttcaaatgcctgcacatacaagtatgatcaataagaaccagtactttgtaaaaaatagtatagcaaatgcatatctgacttaaaagggaagaacggggattttaccagtgcaaagt

SEQ ID NO: 1597 - DNA, 200 bp, Conyza canadensis
acttgtaaatgcgatggagcttgtgtttgctgaccgaagaggtttatggggcactccacttgtgccagtaacgcgcgagcctggacaaaataatgtgggaatggtagcgtggactatggacctctgcacaccagaatttcctgatggtaggacgattttagttgtttcaaatgacgtcacatttaaaaacggatcttttg

SEQ ID NO: 1598 - DNA, 200 bp, Conyza canadensis
caaaagatccgtttttaaatgtgacgtcatttgaaacaactaaaatcgtcctaccatcaggaaattctggtgtgcagaggtccatagtccacgctaccattcccacattattttgtccaggctcgcgcgttactggcacaagtggagtgccccataaacctcttcggtcagcaaacacaagctccatcgcatttacaagt

SEQ ID NO: 1599 - DNA, 200 bp, Conyza canadensis
gtcacatttaaaaacggatcttttggtcctatcgaggatgcgttttttgaggcagtcactgagcttgcttgtgccaaaaaactgccgctcatttacctggcggcaaactcaggggcccgtatcggggtggccgaagaggtcagatccagctttagaattgggtggtctgatgagtcaactcccgactccggctttcagta

SEQ ID NO: 1600 - DNA, 200 bp, Conyza canadensis
tactgaaagccggagtcgggagttgactcatcagaccacccaattctaaagctggatctgacctcttcggccaccccgatacgggcccctgagtttgccgccaggtaaatgagcggcagttttttggcacaagcaagctcagtgactgcctcaaaaaacgcatcctcgataggaccaaaagatccgtttttaaatgtgac

SEQ ID NO: 1601 - DNA, 200 bp, Conyza canadensis
caactcccgactccggctttcagtatttgtatctaactcccgaagattactctcgtttggaatcatcagtaatagcacatgaaattcgtctatccagtggtgaaacaagatgggtcattgatactattgtcgggaaagaggatggattaggggttgagaatttgagtggtagtggggcgattgctggggctttttcgaag

SEQ ID NO: 1602 - DNA, 200 bp, Conyza canadensis
cttcgaaaaagccccagcaatcgccccactaccactcaaattctcaacccctaatccatcctctttcccgacaatagtatcaatgacccatcttgtttcaccactggatagacgaatttcatgtgctattactgatgattccaaacgagagtaatcttcgggagttagatacaaatactgaaagccggagtcgggagttg

SEQ ID NO: 1603 - DNA, 200 bp, Conyza canadensis
ggcgattgctggggctttttcgaaggcatataaagaaacttttactttaacctacgtgactggaagaactgttgggataggtgcatatctggcccgtcttgggatgcgatgcatacaaaggcttgatcaaccgattattttaactgggttttctgcactaaacaagcttttgggccgagaggtttatagttcgcagatgc

SEQ ID NO: 1604 - DNA, 200 bp, Conyza canadensis
gcatctgcgaactataaacctctcggcccaaaagcttgtttagtgcagaaaacccagttaaaataatcggttgatcaagcctttgtatgcatcgcatcccaagacgggccagatatgcacctatcccaacagttcttccagtcacgtaggttaaagtaaaagtttctttatatgccttcgaaaaagccccagcaatcgcc

SEQ ID NO: 1605 - DNA, 200 bp, Conyza canadensis
cgagaggtttatagttcgcagatgcaacttggtggacctaaaattatggccacgaatggcgttgttcatcaaactgtatctgatgatttggaaggtgtctcggctatcttgaactggttgagctatgttccgccttacgttggcggtccacttcctgttttgccacccatggatccaccagacaggcccgtcgagtacct

SEQ ID NO: 1606 - DNA, 200 bp, Conyza canadensis
aggtactcgacgggcctgtctggtggatccatgggtggcaaaacaggaagtggaccgccaacgtaaggcggaacatagctcaaccagttcaagatagccgagacaccttccaaatcatcagatacagtttgatgaacaacgccattcgtggccataattttaggtccaccaagttgcatctgcgaactataaacctctcg

SEQ ID NO: 1607 - DNA, 200 bp, Conyza canadensis
caccagacaggcccgtcgagtacctgcctgaaaactcatgtgatcctagggcagccatttgtgggaccgtggatggtaacgggaaatgggttggtgggattttcgacagaaacagttttgtggagacgttggaaggttgggcaaggacagttgtaacaggtcgggcgaaactcggtggaatccctgtgggggttgttgct

SEQ ID NO: 1608 - DNA, 200 bp, Conyza canadensis
agcaacaacccccacagggattccaccgagtttcgcccgacctgttacaactgtccttgcccaaccttccaacgtctccacaaaactgtttctgtcgaaaatcccaccaacccatttcccgttaccatccacggtcccacaaatggctgccctaggatcacatgagttttcaggcaggtactcgacgggcctgtctggtg

SEQ ID NO: 1609 - DNA, 200 bp, Conyza canadensis
tggaatccctgtgggggttgttgctgtcgagacacaaacgatgatgcaagttatacctgcggatcctgggcagctcgattcacatgaacgtgtagttcctcaagctgggcaggtctggttcccggattctgctagtaagacagctcaagcgctgatggattttaatcgagaagagctcccccttttcattatggcaaact

SEQ ID NO: 1610 - DNA, 200 bp, Conyza canadensis
agtttgccataatgaaaagggggagctcttctcgattaaaatccatcagcgcttgagctgtcttactagcagaatccgggaaccagacctgcccagcttgaggaactacacgttcatgtgaatcgagctgcccaggatccgcaggtataacttgcatcatcgtttgtgtctcgacagcaacaacccccacagggattcca

SEQ ID NO: 1611 - DNA, 200 bp, Conyza canadensis
ctcccccttttcattatggcaaactggcgagggttttcagccggtcaacgtgacctttttgaagggattctacaagcgggatcgacaattgtagagaatcttagaacctataaacagccagtttttgtctacattccaaaaacaggtgagcttcgaggtggtgcatgggtggtcgttgacagtcgaatcaattcagacca

SEQ ID NO: 1612 - DNA, 200 bp, Conyza canadensis
tggtctgaattgattcgactgtcaacgaccacccatgcaccacctcgaagctcacctgtttttggaatgtagacaaaaactggctgtttataggttctaagattctctacaattgtcgatcccgcttgtagaatcccttcaaaaaggtcacgttgaccggctgaaaaccctcgccagtttgccataatgaaaagggggag

SEQ ID NO: 1613 - DNA, 200 bp, Conyza canadensis
ttgacagtcgaatcaattcagaccatatagaaatgtatgcagaaacaactgcgaaaggaaatgttcttgaacccgaaggtatgattgaaataaagttccgaaataaagagctggtagactgcatgggtcgattggacccactaatttgcaatctaaaagaaaaacttaaagaaacgaagctcgatcaagcaatcacccag

SEQ ID NO: 1614 - DNA, 200 bp, Conyza canadensis
ctgggtgattgcttgatcgagcttcgtttctttaagtttttcttttagattgcaaattagtgggtccaatcgacccatgcagtctaccagctctttatttcggaactttatttcaatcataccttcgggttcaagaacatttcctttcgcagttgtttctgcatacatttctatatggtctgaattgattcgactgtcaa

SEQ ID NO: 1615 - DNA, 200 bp, Conyza canadensis
gaagctcgatcaagcaatcacccagcagataaaagcccgtgagaaacagcttttaccaatttacactcaaatcgctacaaagtttgctgaacttcatgacacatcattccgaatggctgaaaaaggtgttgtcaaaaaggttgttgactgggcaatttcccggtttttcttctacaaaagactccagcgtaggctggccg

SEQ ID NO: 1616 - DNA, 200 bp, Conyza canadensis
cggccagcctacgctggagtcttttgtagaagaaaaaccgggaaattgcccagtcaacaacctttttgacaacacctttttcagccattcggaatgatgtgtcatgaagttcagcaaactttgtagcgatttgagtgtaaattggtaaaagctgtttctcacgggcttttatctgctgggtgattgcttgatcgagcttc

SEQ ID NO: 1617 - DNA, 200 bp, Conyza canadensis
aaaagactccagcgtaggctggccgaggcttctctaatcaagagtgctcgtgatgctgctggtgacacgctttcacacaaatctgctcatgaaatgatcaaaaaatggtttttggacacaaaaagtgaagatatgtgggtgaatgacgacgcctttttcacatggaaagatgatccattgaactatactagcaaattagc

SEQ ID NO: 1618 - DNA, 200 bp, Conyza canadensis
gctaatttgctagtatagttcaatggatcatctttccatgtgaaaaaggcgtcgtcattcacccacatatcttcactttttgtgtccaaaaaccattttttgatcatttcatgagcagatttgtgtgaaagcgtgtcaccagcagcatcacgagcactcttgattagagaagcctcggccagcctacgctggagtctttt

SEQ ID NO: 1619 - DNA, 200 bp, Conyza canadensis
cattgaactatactagcaaattagccgatctacgtacacagaagatatcaaatcagttattaaagattggcagttcaccttccgatctgcaagctttaccacagggactcgctgcacttttgcaagaggtaaaccataatatcccgattacctgccgttttaaaattcataaatttcactgttttgtttaactttgttgt

SEQ ID NO: 1620 - DNA, 200 bp, Conyza canadensis
acaacaaagttaaacaaaacagtgaaatttatgaattttaaaacggcaggtaatcgggatattatggtttacctcttgcaaaagtgcagcgagtccctgtggtaaagcttgcagatcggaaggtgaactgccaatctttaataactgatttgatatcttctgtgtacgtagatcggctaatttgctagtatagttcaatg

SEQ ID NO: 1621 - DNA, 200 bp, Conyza canadensis
tcactgttttgtttaactttgttgtgttcttctatgatgtaggtgaatcctgcagccaaaaataaattgattgaagaactcaggcggataattgagtaggaatcgataggtaactattatcaaggagttcttcattataaattttgccagcagtttgagatttttccagccaaatgagaagcctttgaacctgtgtacat

SEQ ID NO: 1622 - DNA, 200 bp, Conyza canadensis
atgtacacaggttcaaaggcttctcatttggctggaaaaatctcaaactgctggcaaaatttataatgaagaactccttgataatagttacctatcgattcctactcaattatccgcctgagttcttcaatcaatttatttttggctgcaggattcacctacatcatagaagaacacaacaaagttaaacaaaacagtga

SEQ ID NO: 1623 - DNA, 200 bp, Conyza canadensis
gagaagcctttgaacctgtgtacattaaggtgttgatagggagatagagtaaagatagtataaattgtaattagtgttcacaagaactttacattagaatcattatatatcatggtcaattcttttaacaaacataattcaaattcatattctgatattcatatgttgaaacaattgcttttctttttgatttttttgtt

SEQ ID NO: 1624 - DNA, 200 bp, Conyza canadensis
aacaaaaaaatcaaaaagaaaagcaattgtttcaacatatgaatatcagaatatgaatttgaattatgtttgttaaaagaattgaccatgatatataatgattctaatgtaaagttcttgtgaacactaattacaatttatactatctttactctatctccctatcaacaccttaatgtacacaggttcaaaggcttctc

SEQ ID NO: 1625 - DNA, 200 bp, Conyza canadensis
tgcttttctttttgatttttttgttctcttttcccttcggtttctgtttctttactttactttctcgtttgcgttcttctttttcctttctctcaagttcttctctttcctttgcttttttcttctttctttcgagttcttcttttttccttaacttatctttctcgtgttttaccttctctttctcgtgttttaccttc

SEQ ID NO: 1626 - DNA, 200 bp, Conyza canadensis
gaaggtaaaacacgagaaagagaaggtaaaacacgagaaagataagttaaggaaaaaagaagaactcgaaagaaagaagaaaaaagcaaaggaaagagaagaacttgagagaaaggaaaaagaagaacgcaaacgagaaagtaaagtaaagaaacagaaaccgaagggaaaagagaacaaaaaaatcaaaaagaaaagca

SEQ ID NO: 1627 - DNA, 200 bp, Conyza canadensis
cttctctttctcgtgttttaccttctctttcattttctttttcattttcttcttctcttttcgtaggagtatccgcttgatgatgttcatacacattcttactttggaattattgtctgcaaatgtcaaatcaatagagaactatgtagatatgctttaaatggcatatacttctttttgtttttgtcaattatttattt

SEQ ID NO: 1628 - DNA, 200 bp, Conyza canadensis
aaataaataattgacaaaaacaaaaagaagtatatgccatttaaagcatatctacatagttctctattgatttgacatttgcagacaataattccaaagtaagaatgtgtatgaacatcatcaagcggatactcctacgaaaagagaagaagaaaatgaaaaagaaaatgaaagagaaggtaaaacacgagaaagagaag

SEQ ID NO: 1629 - DNA, 200 bp, Conyza canadensis
ttttgtttttgtcaattatttatttataggtgcatacatagtgtttatcaacattgtaggaaatgacaaaagtttgtttttcaaacgggcaaaccagattctcgttgtaatcaactgtaacaatgtaggattgtgtttgtccgtcgaccaaatgttgcaagttcgatcaatatctgtacgaacgtttcaatcaacacatc

SEQ ID NO: 1630 - DNA, 200 bp, Conyza canadensis
gatgtgttgattgaaacgttcgtacagatattgatcgaacttgcaacatttggtcgacggacaaacacaatcctacattgttacagttgattacaacgagaatctggtttgcccgtttgaaaaacaaacttttgtcatttcctacaatgttgataaacactatgtatgcacctataaataaataattgacaaaaacaaaa

SEQ ID NO: 1631 - DNA, 200 bp, Conyza canadensis
gtacgaacgtttcaatcaacacatcgaagaataattgaatataatccaagttaatgtttgaaaagcaacaagataacaatataagattggtggtcctgttcagaaaatggtatttatgtttaactgtgtatgaagtaaaacaaacatatgattgagattttaattctcaacatcaatttcaacactaacataagttcatt

SEQ ID NO: 1632 - DNA, 200 bp, Conyza canadensis
aatgaacttatgttagtgttgaaattgatgttgagaattaaaatctcaatcatatgtttgttttacttcatacacagttaaacataaataccattttctgaacaggaccaccaatcttatattgttatcttgttgcttttcaaacattaacttggattatattcaattattcttcgatgtgttgattgaaacgttcgtac

SEQ ID NO: 1633 - DNA, 200 bp, Conyza canadensis
atttcaacactaacataagttcattactaagatatagttttccattattagcttagacttctgtcataaaaaacggacatcaagtaaatgtagaaaaatgtagcgtcatatgtctttacacggattcaaaccattatacaacttacaaactgttgacggttatatcatgtgcaattgtctaacagaatccaaaagcgtaa

SEQ ID NO: 1634 - DNA, 200 bp, Conyza canadensis
ttacgcttttggattctgttagacaattgcacatgatataaccgtcaacagtttgtaagttgtataatggtttgaatccgtgtaaagacatatgacgctacatttttctacatttacttgatgtccgttttttatgacagaagtctaagctaataatggaaaactatatcttagtaatgaacttatgttagtgttgaaat

SEQ ID NO: 1635 - DNA, 200 bp, Conyza canadensis
tgtctaacagaatccaaaagcgtaaaaaaaagaggcaaaattgcagtttcctacattgttctctttatctccaagccctagtcatttcatgtataaacaatctaacaaacaagcttattctgtaaaaaatccaacaattctgatttcatatataggttgagtacatatggggattctaactagtgagtagtgactctaaa

SEQ ID NO: 1636 - DNA, 200 bp, Conyza canadensis
tttagagtcactactcactagttagaatccccatatgtactcaacctatatatgaaatcagaattgttggattttttacagaataagcttgtttgttagattgtttatacatgaaatgactagggcttggagataaagagaacaatgtaggaaactgcaattttgcctcttttttttacgcttttggattctgttagaca

SEQ ID NO: 1637 - DNA, 200 bp, Conyza canadensis
ctaactagtgagtagtgactctaaactttaattcttcttgcacttcacattttactgatgaggtcagacctcatgagcagactttgatgaacatgtatgaacagcatctgcaactgtgagaaaaatcttgttttcgccaatcaagtcagggaaatccgctgcatatagcttgtctaggacgagttgcccggggtttgcaa

SEQ ID NO: 1638 - DNA, 200 bp, Conyza canadensis
ttgcaaaccccgggcaactcgtcctagacaagctatatgcagcggatttccctgacttgattggcgaaaacaagatttttctcacagttgcagatgctgttcatacatgttcatcaaagtctgctcatgaggtctgacctcatcagtaaaatgtgaagtgcaagaagaattaaagtttagagtcactactcactagttag

SEQ ID NO: 1639 - DNA, 200 bp, Conyza canadensis
aggacgagttgcccggggtttgcaagaacaagctgccatgtcaatttagtttttagtccttgagatggcattacaacacatgcaatttattatttatacacacttagaaccatttgttaataaattggagactgttttactaacctgaacatctctcttttgcaaacttctgtgtaactcttcaaaggcatggattccac

SEQ ID NO: 1640 - DNA, 200 bp, Conyza canadensis
gtggaatccatgcctttgaagagttacacagaagtttgcaaaagagagatgttcaggttagtaaaacagtctccaatttattaacaaatggttctaagtgtgtataaataataaattgcatgtgttgtaatgccatctcaaggactaaaaactaaattgacatggcagcttgttcttgcaaaccccgggcaactcgtcct

SEQ ID NO: 1641 - DNA, 200 bp, Conyza canadensis
aactcttcaaaggcatggattccactggtgtcaatatcagtaacagctgcaattaggcaaccatacgttagagagaaaagtttcaatgacccaaaatgtaaaggtaaccatggtaaaagctagtttcttacgcgacatttcaactattaagaattgaatatttggtaggtatgctgcttttagattttcttcttcctcag

SEQ ID NO: 1642 - DNA, 200 bp, Conyza canadensis
ctgaggaagaagaaaatctaaaagcagcatacctaccaaatattcaattcttaatagttgaaatgtcgcgtaagaaactagcttttaccatggttacctttacattttgggtcattgaaacttttctctctaacgtatggttgcctaattgcagctgttactgatattgacaccagtggaatccatgcctttgaagagtt

SEQ ID NO: 1643 - DNA, 200 bp, Conyza canadensis
atgaattttcgggcatttgatctgaagctcaacatttttccgggcgattcaaataagcgttttactgttacaaaaagtttcgtctcaacgggtgaccactacacgacttctgataacaccaatccgaccagtcttacaaaggtgaaggtgaagaaacatgtgaagagggataaatttggagaaagaatggcatcactaaa

SEQ ID NO: 1644 - DNA, 200 bp, Conyza canadensis
tttagtgatgccattctttctccaaatttatccctcttcacatgtttcttcaccttcacctttgtaagactggtcggattggtgttatcagaagtcgtgtagtggtcacccgttgagacgaaactttttgtaacagtaaaacgcttatttgaatcgcccggaaaaatgttgagcttcagatcaaatgcccgaaaattcat

SEQ ID NO: 1645 - DNA, 200 bp, Conyza canadensis
ttggagaaagaatggcatcactaaaacagatagtgtcaccctatggcaaggagtctagacttggaccattgtgttttagagaagaagggaatcgaacgcaaagtggcaccatgtcagaagctcaaagaatgcttctaagtggaagtttcaattattatggtaatggcattgtaaatggggcgatttcactgaggtcttct

SEQ ID NO: 1646 - DNA, 200 bp, Conyza canadensis
agaagacctcagtgaaatcgccccatttacaatgccattaccataataattgaaacttccacttagaagcattctttgagcttctgacatggtgccactttgcgttcgattcccttcttctctaaaacacaatggtccaagtctagactccttgccatagggtgacactatctgttttagtgatgccattctttctccaa

SEQ ID NO: 1647 - DNA, 200 bp, Conyza canadensis
tggggcgatttcactgaggtcttctgctagtagatctgcaattgatgaattttgtaatgcacttggaggcaccaggccaatccaaagtattttaattgcaaataatggaatggcggctgtaaagtttataagaagtgtgaggacatggagttatgaaacatttggctcagataaagctattttgctggtagccatggcta

SEQ ID NO: 1648 - DNA, 200 bp, Conyza canadensis
tagccatggctaccagcaaaatagctttatctgagccaaatgtttcataactccatgtcctcacacttcttataaactttacagccgccattccattatttgcaattaaaatactttggattggcctggtgcctccaagtgcattacaaaattcatcaattgcagatctactagcagaagacctcagtgaaatcgcccca

SEQ ID NO: 1649 - DNA, 200 bp, Conyza canadensis
gctattttgctggtagccatggctacaccggaagatatgaggataaatgccgagcatattagaatcgctgatcagtttgttgaagtccctggtggtacaaataataataattatgcgaatgtgcaactcattgtagagactgctgagataacacatgttgatgctgtttggcctggttggggccatgcatccgaaatccc

SEQ ID NO: 1650 - DNA, 200 bp, Conyza canadensis
gggatttcggatgcatggccccaaccaggccaaacagcatcaacatgtgttatctcagcagtctctacaatgagttgcacattcgcataattattattatttgtaccaccagggacttcaacaaactgatcagcgattctaatatgctcggcatttatcctcatatcttccggtgtagccatggctaccagcaaaatagc

SEQ ID NO: 1651 - DNA, 200 bp, Conyza canadensis
gttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcatgtaaaaattcctgtggatagctgtttggac

SEQ ID NO: 1652 - DNA, 200 bp, Conyza canadensis
gtccaaacagctatccacaggaatttttacatgagaaccgctccaaggaagtgtcggtacatcagcagcttgtgcaatcaaagaagaaccaattttatcacctaaagctgccatggaggaagctggtggcccaagaaatacaataccttttgcttccaatgcatcaggcagctcagggatttcggatgcatggccccaac

SEQ ID NO: 1653 - DNA, 200 bp, Conyza canadensis
aattcctgtggatagctgtttggacacactcccggatgatgtatatagaaaagcgtgtgtgcatacaacagaagaagcaattgctagttgtcaagttgttggttatccagcaatgattaaggcatcatggggtggaggtggcaaaggcataagaaaggtgcataatgacgaagaagtcaaggcactttttaagcaagttc

SEQ ID NO: 1654 - DNA, 200 bp, Conyza canadensis
gaacttgcttaaaaagtgccttgacttcttcgtcattatgcacctttcttatgcctttgccacctccaccccatgatgccttaatcattgctggataaccaacaacttgacaactagcaattgcttcttctgttgtatgcacacacgcttttctatatacatcatccgggagtgtgtccaaacagctatccacaggaatt

SEQ ID NO: 1655 - DNA, 200 bp, Conyza canadensis
gtcaaggcactttttaagcaagttcagggtgaagtgcctggttcccctattttcattatgaaagttgcttctcagagccgacatctagaagtgcagctactatgcgatcaacatgggaatgtagcagctttgcatagtcgtgattgcagtgttcaaaggcgacatcaaaagattattgaagaggggccaataaccatagc

SEQ ID NO: 1656 - DNA, 200 bp, Conyza canadensis
gctatggttattggcccctcttcaataatcttttgatgtcgcctttgaacactgcaatcacgactatgcaaagctgctacattcccatgttgatcgcatagtagctgcacttctagatgtcggctctgagaagcaactttcataatgaaaataggggaaccaggcacttcaccctgaacttgcttaaaaagtgccttgac

SEQ ID NO: 1657 - DNA, 200 bp, Conyza canadensis
ttgaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggttgagcatccagtcacagagtggatagcg

SEQ ID NO: 1658 - DNA, 200 bp, Conyza canadensis
cgctatccactctgtgactggatgctcaacctgtaaccggggattgagctccaaaaagtaatagtctccagtttccatgctatacaaatactctacagtggctgctccaacataattaaccgactttgctaatcttctcgccgcttgctcaagcttctttattgtgtcatgtggagctatggttattggcccctcttcaa

SEQ ID NO: 1659 - DNA, 200 bp, Conyza canadensis
gcatccagtcacagagtggatagcggaaatcaatctacctgcagcacaagttgcggttggaatgggcattcctctttggcaaataccagaaataagacgattttatggaatggacaatagtggaggatacgatgcttggaggagaacatctgctcttgcaactccatttgactttgacaaggcagagtctatcagcccaa

SEQ ID NO: 1660 - DNA, 200 bp, Conyza canadensis
ttgggctgatagactctgccttgtcaaagtcaaatggagttgcaagagcagatgttctcctccaagcatcgtatcctccactattgtccattccataaaatcgtcttatttctggtatttgccaaagaggaatgcccattccaaccgcaacttgtgctgcaggtagattgatttccgctatccactctgtgactggatgc

SEQ ID NO: 1661 - DNA, 200 bp, Conyza canadensis
gacaaggcagagtctatcagcccaaaaggtcattgtattgctgtacgtgtaacaagtgaggacccagatgatggatttaagcccactagtggaaaagttcaggagctaagttttaaaagcaagccaaatgtctgggcatacttttctgtcaagtccggaggaggcattcatgaattctcagattctcaatttggccacgt

SEQ ID NO: 1662 - DNA, 200 bp, Conyza canadensis
acgtggccaaattgagaatctgagaattcatgaatgcctcctccggacttgacagaaaagtatgcccagacatttggcttgcttttaaaacttagctcctgaacttttccactagtgggcttaaatccatcatctgggtcctcacttgttacacgtacagcaatacaatgaccttttgggctgatagactctgccttgtc

SEQ ID NO: 1663 - DNA, 200 bp, Conyza canadensis
tctcagattctcaatttggccacgtttttgcatttggcgagtcaagacctttggctattgcaaatatggttcttgggctgaaggaaattcaaattcgtggcgagatccgtacgaatgttgattatacaattgatctgttacatgctcctgattatagagaaaataaaatacataccggttggttagatagccgaattgct

SEQ ID NO: 1664 - DNA, 200 bp, Conyza canadensis
agcaattcggctatctaaccaaccggtatgtattttattttctctataatcaggagcatgtaacagatcaattgtataatcaacattcgtacggatctcgccacgaatttgaatttccttcagcccaagaaccatatttgcaatagccaaaggtcttgactcgccaaatgcaaaaacgtggccaaattgagaatctgaga

SEQ ID NO: 1665 - DNA, 200 bp, Conyza canadensis
cggttggttagatagccgaattgctatgagggttagagcagaaaggcccccttggtatctttcagtagttgggggagcactttacaaagctgctgctagaagtgcagccatggtctcggactatgttggttaccttgaaaagggccaaatccctcctaagcatatatcattggtcaactcacaagtttctttgaatattg

SEQ ID NO: 1666 - DNA, 200 bp, Conyza canadensis
caatattcaaagaaacttgtgagttgaccaatgatatatgcttaggagggatttggcccttttcaaggtaaccaacatagtccgagaccatggctgcacttctagcagcagctttgtaaagtgctcccccaactactgaaagataccaagggggcctttctgctctaaccctcatagcaattcggctatctaaccaaccg

SEQ ID NO: 1667 - DNA, 200 bp, Conyza canadensis
aactcacaagtttctttgaatattgagggcagcaaatacacgattgatatggtaaaaagagggccaggaagttacagattgagaatgaatcaatccgagattgaagcagagatacatacactacgtgacggaggcttattgatgcagttggatgggaatagtcatatattatacgccgaggaagaagctgccggtactcg

SEQ ID NO: 1668 - DNA, 200 bp, Conyza canadensis
cgagtaccggcagcttcttcctcggcgtataatatatgactattcccatccaactgcatcaataagcctccgtcacgtagtgtatgtatctctgcttcaatctcggattgattcattctcaatctgtaacttcctggccctctttttaccatatcaatcgtgtatttgctgccctcaatattcaaagaaacttgtgagtt

SEQ ID NO: 1669 - DNA, 200 bp, Conyza canadensis
ccgaggaagaagctgccggtactcgcttgcttattgatggacggacttgcttgcttcagaatgatcatgatccttccaagttgatggctgaaacaccatgcaaacttctaaggtacttggtctcagatgatagccatgttaatgctgacacaccgtatgctgaggttgaagttatgaagatgtgtatgccactcctttca

SEQ ID NO: 1670 - DNA, 200 bp, Conyza canadensis
tgaaaggagtggcatacacatcttcataacttcaacctcagcatacggtgtgtcagcattaacatggctatcatctgagaccaagtaccttagaagtttgcatggtgtttcagccatcaacttggaaggatcatgatcattctgaagcaagcaagtccgtccatcaataagcaagcgagtaccggcagcttcttcctcgg

SEQ ID NO: 1671 - DNA, 200 bp, Conyza canadensis
gaagatgtgtatgccactcctttcaccggctgctggagttatacaattcaagatgtcagaaggtcaagccatgcaggctggtgagcttatagcaaggctagatcttgacgatccgtcagctgtaagaaaagcagagcctttcaatggaaactttcctcttcttgggcctccaacggccatgtcagacaaagtgcatcaga

SEQ ID NO: 1672 - DNA, 200 bp, Conyza canadensis
tctgatgcactttgtctgacatggccgttggaggcccaagaagaggaaagtttccattgaaaggctctgcttttcttacagctgacggatcgtcaagatctagccttgctataagctcaccagcctgcatggcttgaccttctgacatcttgaattgtataactccagcagccggtgaaaggagtggcatacacatcttc

SEQ ID NO: 1673 - DNA, 200 bp, Conyza canadensis
gccatgtcagacaaagtgcatcagaagtgtgctgcaactttaaatgctgctcgaatgattctcgcaggctatgatcataacattgatgaattggaatccaagtttaaggagtacgaaggaatttccacacaacaaactattgactttcctgctagagttctacgggtcattcttgaaacccatcttggatcttgctcaga

SEQ ID NO: 1674 - DNA, 200 bp, Conyza canadensis
tctgagcaagatccaagatgggtttcaagaatgacccgtagaactctagcaggaaagtcaatagtttgttgtgtggaaattccttcgtactccttaaacttggattccaattcatcaatgttatgatcatagcctgcgagaatcattcgagcagcatttaaagttgcagcacacttctgatgcactttgtctgacatggc

SEQ ID NO: 1675 - DNA, 200 bp, Conyza canadensis
aaacccatcttggatcttgctcagaaaaagaaaagggagcccaagaaaggctcgttgagccattaatgggtcttgtaaagtcgtatgaagggggaagagaaagtcatgcacgtgggatcgttcatgctctatttgatgaatatttatctgttgaagagttgttcagcgacaacattcaggctgatgtaatcgaacgtctt

SEQ ID NO: 1676 - DNA, 200 bp, Conyza canadensis
aagacgttcgattacatcagcctgaatgttgtcgctgaacaactcttcaacagataaatattcatcaaatagagcatgaacgatcccacgtgcatgactttctcttcccccttcatacgactttacaagacccattaatggctcaacgagcctttcttgggctcccttttctttttctgagcaagatccaagatgggttt

SEQ ID NO: 1677 - DNA, 200 bp, Conyza canadensis
tcaggctgatgtaatcgaacgtcttcgacaactatacaagaaagatctcttgaggattgtcgacattgtcctttcccatcagggtgttaggagtaaaaacaaattgatactacggctgatggagcatttggtttaccccaatccggctgcgtatagggagaaactgatacgattttctcaacttaaccacacaagttatt

SEQ ID NO: 1678 - DNA, 200 bp, Conyza canadensis
aataacttgtgtggttaagttgagaaaatcgtatcagtttctccctatacgcagccggattggggtaaaccaaatgctccatcagccgtagtatcaatttgtttttactcctaacaccctgatgggaaaggacaatgtcgacaatcctcaagagatctttcttgtatagttgtcgaagacgttcgattacatcagcctga

SEQ ID NO: 1679 - DNA, 200 bp, Conyza canadensis
tctcaacttaaccacacaagttattctgagttagcactgaaggcaagtcaacttttagaacaaactaaactaagtgaacttcgttcaagcattgcgcgaagtctttctgaattagagatgtttactgaagaaggtgaaaatatggatacccctaagaggaagagtgccattaatgaaagaatggaggatattgtgagtgc

SEQ ID NO: 1680 - DNA, 200 bp, Conyza canadensis
gcactcacaatatcctccattctttcattaatggcactcttcctcttaggggtatccatattttcaccttcttcagtaaacatctctaattcagaaagacttcgcgcaatgcttgaacgaagttcacttagtttagtttgttctaaaagttgacttgccttcagtgctaactcagaataacttgtgtggttaagttgaga

SEQ ID NO: 1681 - DNA, 200 bp, Conyza canadensis
aaagaatggaggatattgtgagtgctccattggcagttgaagatgcccttgttggtctttttgaccatagcgatcacacccttcaaaggcgtgttgttgagacctatgttcgaagattatatcagccatatctcgtgaaggggagtgttagaatgcagtggcacagatccggactcatcgctacatggcaatttatagaa

SEQ ID NO: 1682 - DNA, 200 bp, Conyza canadensis
ttctataaattgccatgtagcgatgagtccggatctgtgccactgcattctaacactccccttcacgagatatggctgatataatcttcgaacataggtctcaacaacacgcctttgaagggtgtgatcgctatggtcaaaaagaccaacaagggcatcttcaactgccaatggagcactcacaatatcctccattcttt

SEQ ID NO: 1683 - DNA, 200 bp, Conyza canadensis
catcgctacatggcaatttatagaaggactcattggagaagttaatgtgcctgactatgaacagaatgaagctcccttggaagacaagaaatggggagctatggttattattaaatctcttcaatttttgcctgatgtcataagtgcatctcttaaagaaacgagtcataaccttcccagaacaagtcagaatgggtttg

SEQ ID NO: 1684 - DNA, 200 bp, Conyza canadensis
caaacccattctgacttgttctgggaaggttatgactcgtttctttaagagatgcacttatgacatcaggcaaaaattgaagagatttaataataaccatagctccccatttcttgtcttccaagggagcttcattctgttcatagtcaggcacattaacttctccaatgagtccttctataaattgccatgtagcgatg

SEQ ID NO: 1685 - DNA, 200 bp, Conyza canadensis
cccagaacaagtcagaatgggtttgctggtcatagtaaccatggtaatatgatgcacattgctttggccggcataaataaccagatgagtttgcttcaagacagtggtgatgaggatcaggctcaagagagagtcaacaggttagcaaaaatactcaaagataaagaagtaagctcgagtcttaaaaacgcagggtatgg

SEQ ID NO: 1686 - DNA, 200 bp, Conyza canadensis
ccataccctgcgtttttaagactcgagcttacttctttatctttgagtatttttgctaacctgttgactctctcttgagcctgatcctcatcaccactgtcttgaagcaaactcatctggttatttatgccggccaaagcaatgtgcatcatattaccatggttactatgaccagcaaacccattctgacttgttctggg

SEQ ID NO: 1687 - DNA, 200 bp, Conyza canadensis
cgagtcttaaaaacgcagggtatggagtgatcagttgtataatacaaagagatgaagggagaggccccatgagacactcatttcactggtcagaagagaatcattattatattgaagagccattattgcgtcacttggagcctccattatcgacatatcttgaactggacaaacttaagggctatgataatataaagtac

SEQ ID NO: 1688 - DNA, 200 bp, Conyza canadensis
gtactttatattatcatagcccttaagtttgtccagttcaagatatgtcgataatggaggctccaagtgacgcaataatggctcttcaatataataatgattctcttctgaccagtgaaatgagtgtctcatggggcctctcccttcatctctttgtattatacaactgatcactccataccctgcgtttttaagactcg

SEQ ID NO: 1689 - DNA, 200 bp, Conyza canadensis
taagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggttaccaaggttcagaagatgagggcccacggtctcagttaaatctccctttta

SEQ ID NO: 1690 - DNA, 200 bp, Conyza canadensis
taaaagggagatttaactgagaccgtgggccctcatcttctgaaccttggtaacctgagggcgagaaccattcctttgttggatgccttataagagttctaagaaacattctttgtaccggaagtggtttagcatcaacagtatacatgtgccattgacggtcacgcgacggagtgtactttatattatcatagccctta

SEQ ID NO: 1691 - DNA, 200 bp, Conyza canadensis
cggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaattggtgatcttgttccatacacaacgagagtggatgtagattctgggacaga

SEQ ID NO: 1692 - DNA, 200 bp, Conyza canadensis
tctgtcccagaatctacatccactctcgttgtgtatggaacaagatcaccaatttgttgctccttcaatacatataggtacatatgagcatggtcagacttgacagtagcattatgaacatgaagttccaactcctccatagccgtcactaatgatctcaagatgctccttgatgtaaaagggagatttaactgagaccg

SEQ ID NO: 1693 - DNA, 200 bp, Conyza canadensis
gagtggatgtagattctgggacagaagattgcgtggttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacc

SEQ ID NO: 1694 - DNA, 200 bp, Conyza canadensis
ggtatgaccagtcacatttgtgaccacaaccctccacgcaccgttggcttgacccgatgatgccatgcaaagcttcacctcccactcaaaaactcccaaccggtgcatctttacaccaaccattgaatggatttcacgagccagccttaccaaaagtgtctcaaccacgcaatcttctgtcccagaatctacatccactc

SEQ ID NO: 1695 - DNA, 200 bp, Conyza canadensis
ggtcacaaatgtgactggtcatacctgcgttgtgcatgtatatcgtgaactggaagatactggtttgcacaaggtgtatcatgctacctctacattgggtcctttgcatggcgtacctgtgaatacaccctttcagcctttaggattacttgatcagaagcgtcttttggcaaggaaaagcaatactacgtactgctacg

SEQ ID NO: 1696 - DNA, 200 bp, Conyza canadensis
cgtagcagtacgtagtattgcttttccttgccaaaagacgcttctgatcaagtaatcctaaaggctgaaagggtgtattcacaggtacgccatgcaaaggacccaatgtagaggtagcatgatacaccttgtgcaaaccagtatcttccagttcacgatatacatgcacaacgcaggtatgaccagtcacatttgtgacc

SEQ ID NO: 1697 - DNA, 200 bp, Conyza canadensis
aaaagcaatactacgtactgctacgactttgcactggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggt

SEQ ID NO: 1698 - DNA, 200 bp, Conyza canadensis
accttgttttgccctggctcacgatttactgcaacaaggggagttccccatgagccacttggctcagcaaacatgagctccgtcacattcacaagtttacccttaggcctgctatcacttacgactttcgacgcccagatattctcaagagctgcttcaaatgccagtgcaaagtcgtagcagtacgtagtattgctttt

SEQ ID NO: 1699 - DNA, 200 bp, Conyza canadensis
atcgtgagccagggcaaaacaaggtgggcatggtggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatac

SEQ ID NO: 1700 - DNA, 200 bp, Conyza canadensis
gtatattagtggcagtttcttggcacaagcgagatcagtaactgcctcaaaaaaggcatcctcaagaggaccaaaagatccatttttgaacgtaacatcgtttgctactaccaaaatcgttcttccatcaggaaactcaggagtgcagaggtccatagtccacgccaccatgcccaccttgttttgccctggctcacgat

SEQ ID NO: 1701 - DNA, 200 bp, Conyza canadensis
tgccaagaaactgccactaatatacttggcagcaaactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaa

SEQ ID NO: 1702 - DNA, 200 bp, Conyza canadensis
ttgatagatgaacctcatgagctattacagatgatttgatgtgggtataatcttcaggagtaagatacaaatactggaatcccgattcaggagtcgactcatcagaccacccaattctaaagcaagatctgacttcctcagccgctccgatacgggcccccgagtttgctgccaagtatattagtggcagtttcttggca

SEQ ID NO: 1703 - DNA, 200 bp, Conyza canadensis
atagctcatgaggttcatctatcaaatggcgaaacaagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacg

SEQ ID NO: 1704 - DNA, 200 bp, Conyza canadensis
cgtgccagatatgcgcctatcccaactgttcttccagtaacatatgttaatgtaaacgtttccttatatgctttcgaataggcaccagcaattgccccgctaccactcaaattttcaaccccgagtccgtcttcttttcccacaatagtatcgatgacatatcttgtttcgccatttgatagatgaacctcatgagctat

SEQ ID NO: 1705 - DNA, 200 bp, Conyza canadensis
ttgggataggcgcatatctggcacgtcttgggatgcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggt

SEQ ID NO: 1706 - DNA, 200 bp, Conyza canadensis
accttcgagatcatcggacaccgttaaatggacaacaccattcgtagccataattttaggcccacctagttgcatctgtgagctataaacctctcggcccaaaagcttgttcagtgcagaaaaacccgttaatataatcggttgatcaagccgctgtatgcaccgcatcccaagacgtgccagatatgcgcctatcccaa

SEQ ID NO: 1707 - DNA, 200 bp, Conyza canadensis
aacggtgtccgatgatctcgaaggtgtctcagctatcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtg

SEQ ID NO: 1708 - DNA, 200 bp, Conyza canadensis
caccagcccattcaccgttgctatccacgaccccacaaatagctgcccgaggatcacatgagttttcagggaggtactcaacgggcctttctggtggatccacaggtgctaaaacaggaagtgggccaccgacataaggtggaacaaagctcaaccaattcaagatagctgagacaccttcgagatcatcggacaccgtt

SEQ ID NO: 1709 - DNA, 200 bp, Conyza canadensis
gatagcaacggtgaatgggctggtgggattttcgatagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgt

SEQ ID NO: 1710 - DNA, 200 bp, Conyza canadensis
acaacacgttcgtgtgaatcaagctgcccgggatctgcaggtatttcttgcatcactgtttgtgtctcaacagcaacgatcccgactgggatcccgccaagtttggcacgacccgttacgactgtcctcgcccaaccttccaatgtctccacaaaactgtctctatcgaaaatcccaccagcccattcaccgttgctatc

SEQ ID NO: 1711 - DNA, 200 bp, Conyza canadensis
agcttgattcacacgaacgtgttgttcctcaagcaggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgag

SEQ ID NO: 1712 - DNA, 200 bp, Conyza canadensis
ctcaacaattgttgaccctgcttgtaaaatcccttcaaaaagatcccgctgacctgcagaaaagcctcgccagttagccatgatgaaaagtgggagctcttctcggttgaaatccatcaatgcctgagctgttttgctggcggaatccgggaaccagacctgacctgcttgaggaacaacacgttcgtgtgaatcaagct

SEQ ID NO: 1713 - DNA, 200 bp, Conyza canadensis
acaagcagggtcaacaattgttgagaatctcagaacatataaccagcctgtttttgtatacatcccgaaaactggagaacttcgtggtggtgcatgggtggttgtcgacagtcgaatcaattcagatcatatagaaatgtatgcagaaaccacagcaaaaggaaatgtccttgaacctgaaggtatgattgagattaagt

SEQ ID NO: 1714 - DNA, 200 bp, Conyza canadensis
acttaatctcaatcataccttcaggttcaaggacatttccttttgctgtggtttctgcatacatttctatatgatctgaattgattcgactgtcgacaaccacccatgcaccaccacgaagttctccagttttcgggatgtatacaaaaacaggctggttatatgttctgagattctcaacaattgttgaccctgcttgt

SEQ ID NO: 1715 - DNA, 200 bp, Conyza canadensis
cctgaaggtatgattgagattaagttccgaaacaaagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttca

SEQ ID NO: 1716 - DNA, 200 bp, Conyza canadensis
tgaagttcagcgaatttggtagcaatttgagtgtaaatcggtaaaagctgtttttcacgagattttatctgttggacgatcgtttgatcgtactttgtttctcgaagtctttctttaaggcttcgaatctgtggatctagacgacccatacagtctatcaattctttgtttcggaacttaatctcaatcataccttcagg

SEQ ID NO: 1717 - DNA, 200 bp, Conyza canadensis
ttgctaccaaattcgctgaacttcatgacacatcattgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttg

SEQ ID NO: 1718 - DNA, 200 bp, Conyza canadensis
caactcatgagcagacttgtaggaaagagtatcaccagcagcttcacgagcactactgatcaaggaagcctctgcgagcctacgacgaagccttttgtaaaagaaaaaccgagatactttccagtcaacaacttgtttgaccacacctttttcagccattcgcaatgatgtgtcatgaagttcagcgaatttggtagcaa

SEQ ID NO: 1719 - DNA, 200 bp, Conyza canadensis
ttcctacaagtctgctcatgagttgattaagaaatggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctt

SEQ ID NO: 1720 - DNA, 200 bp, Conyza canadensis
aagcttgtagatccaatggtgaattaccaatctttaataactgatccaagagcttctgagtacgtagcttggctaacttgtcattatagttcatcagattgtctttccaagtgaaaaaagcatcatcactaagccataaatcttcagttttcgattccaaaaaccatttcttaatcaactcatgagcagacttgtaggaa

SEQ ID NO: 1721 - DNA, 200 bp, Conyza canadensis
atgaattttcgggcatttgatctgaagctcaacatttttctgggcgattcaaataagcgttttactgttacaaaaagtttcgtctcaacgggtgaccactacacgacttctgataacaccaatccgaccagtcttacaaaggtgaaggtgaagaaacatgtgaagagggataaatttggagaaagaatggcatcactaaa

SEQ ID NO: 1722 - DNA, 200 bp, Conyza canadensis
tttagtgatgccattctttctccaaatttatccctcttcacatgtttcttcaccttcacctttgtaagactggtcggattggtgttatcagaagtcgtgtagtggtcacccgttgagacgaaactttttgtaacagtaaaacgcttatttgaatcgcccagaaaaatgttgagcttcagatcaaatgcccgaaaattcat

SEQ ID NO: 1723 - DNA, 200 bp, Conyza canadensis
ttggagaaagaatggcatcactaaaacagatagtgtcaccctatggcaaggattttgctaaacatagttgtaagggttatagttacaacacaatagaatggagtctagacttggaccattgtgttttagagaagaagggaatcgaacgcaaagtttgcgttgtgatagtcaggagacagaaagggcaatttgtttctgtt

SEQ ID NO: 1724 - DNA, 200 bp, Conyza canadensis
aacagaaacaaattgccctttctgtctcctgactatcacaacgcaaactttgcgttcgattcccttcttctctaaaacacaatggtccaagtctagactccattctattgtgttgtaactataacccttacaactatgtttagcaaaatccttgccatagggtgacactatctgttttagtgatgccattctttctccaa

SEQ ID NO: 1725 - DNA, 200 bp, Conyza canadensis
acagaaagggcaatttgtttctgttctttttaagttagatagtggcaccatgtcagaagctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaa

SEQ ID NO: 1726 - DNA, 200 bp, Conyza canadensis
tttggattggcctggtgcctccaagtgcattacaaaattcatcaattgcagatctactagcagaagacctcagtgaaatcgccccatttacaatgccattaccataataattgaaacttccacttagaagcattctttgagcttctgacatggtgccactatctaacttaaaaagaacagaaacaaattgccctttctgt

SEQ ID NO: 1727 - DNA, 200 bp, Conyza canadensis
cttggaggcaccaggccaatccaaagtattttaattgcaaataatggaatggcggctgtaaagtttataagaagtgtgaggacatggagttatgaaacatttggctcagataaagctattttgctggtagccatggctacaccggaagatatgaggataaatgccgagcatattagaatcgctgatcagtttgttgaagt

SEQ ID NO: 1728 - DNA, 200 bp, Conyza canadensis
acttcaacaaactgatcagcgattctaatatgctcggcatttatcctcatatcttccggtgtagccatggctaccagcaaaatagctttatctgagccaaatgtttcataactccatgtcctcacacttcttataaactttacagccgccattccattatttgcaattaaaatactttggattggcctggtgcctccaag

SEQ ID NO: 1729 - DNA, 200 bp, Conyza canadensis
gaatcgctgatcagtttgttgaagtccctggtggtacaaataataataattatgcgaatgtgcaactcattgtagagactgctgagataacacatgttgatgctgtttggcctggttggggccatgcatccgaaatccctgagctgcctgatgcattggaagcaaaaggtattgtatttcttgggccaccagcttcctcc

SEQ ID NO: 1730 - DNA, 200 bp, Conyza canadensis
ggaggaagctggtggcccaagaaatacaataccttttgcttccaatgcatcaggcagctcagggatttcggatgcatggccccaaccaggccaaacagcatcaacatgtgttatctcagcagtctctacaatgagttgcacattcgcataattattattatttgtaccaccagggacttcaacaaactgatcagcgattc

SEQ ID NO: 1731 - DNA, 200 bp, Conyza canadensis
atttcttgggccaccagcttcctccatggcagctttaggtgataaaattggttcttctttgattgcacaagctgctgatgtaccgacacttccttggagcggttctcatgtaaaaattcctgtggatagctgtttggacacactcccggatgatgtatatagaaaagcgtgtgtgcatacaacagaagaagcaattgcta

SEQ ID NO: 1732 - DNA, 200 bp, Conyza canadensis
tagcaattgcttcttctgttgtatgcacacacgcttttctatatacatcatccgggagtgtgtccaaacagctatccacaggaatttttacatgagaaccgctccaaggaagtgtcggtacatcagcagcttgtgcaatcaaagaagaaccaattttatcacctaaagctgccatggaggaagctggtggcccaagaaat

SEQ ID NO: 1733 - DNA, 200 bp, Conyza canadensis
catacaacagaagaagcaattgctagttgtcaagttgttggttatccagcaatgattaaggcatcatggggtggaggtggcaaaggcataagaaaggtgcataatgacgaagaagtcaaggcactttttaagcaagttcagggtgaagtgcctggttcccctattttcattatgaaagttgcttctcagagccgacatct

SEQ ID NO: 1734 - DNA, 200 bp, Conyza canadensis
agatgtcggctctgagaagcaactttcataatgaaaataggggaaccaggcacttcaccctgaacttgcttaaaaagtgccttgacttcttcgtcattatgcacctttcttatgcctttgccacctccaccccatgatgccttaatcattgctggataaccaacaacttgacaactagcaattgcttcttctgttgtatg

SEQ ID NO: 1735 - DNA, 200 bp, Conyza canadensis
aagttgcttctcagagccgacatctagaagtgcagctactatgcgatcaacatgggaatgtagcagctttgcatagtcgtgattgcagtgttcaaaggcgacatcaaaagattattgaagaggggccaataaccatagctccacatgacacaataaagaagcttgagcaagcggcgagaagattagcaaagtcggttaat

SEQ ID NO: 1736 - DNA, 200 bp, Conyza canadensis
attaaccgactttgctaatcttctcgccgcttgctcaagcttctttattgtgtcatgtggagctatggttattggcccctcttcaataatcttttgatgtcgcctttgaacactgcaatcacgactatgcaaagctgctacattcccatgttgatcgcatagtagctgcacttctagatgtcggctctgagaagcaactt

SEQ ID NO: 1737 - DNA, 200 bp, Conyza canadensis
gagaagattagcaaagtcggttaattatgttggagcagccactgtagagtatttgtatagcatggaaactggagactattactttttggagctcaatccccggttacaggttgagcatccagtcacagagtggatagcggaaatcaatctacctgcagcacaagttgcggttggaatgggcattcctctttggcaaatac

SEQ ID NO: 1738 - DNA, 200 bp, Conyza canadensis
gtatttgccaaagaggaatgcccattccaaccgcaacttgtgctgcaggtagattgatttccgctatccactctgtgactggatgctcaacctgtaaccggggattgagctccaaaaagtaatagtctccagtttccatgctatacaaatactctacagtggctgctccaacataattaaccgactttgctaatcttctc

SEQ ID NO: 1739 - DNA, 200 bp, Conyza canadensis
atgggcattcctctttggcaaataccagaaataagacgattttatggaatggacaatagtggaggatacgatgcttggaggagaacatctgctcttgcaactccatttgactttgacaaggcagagtctatcagcccaaaaggtcattgtattgctgtacgtgtaacaagtgaggacccagatgatggatttaagcccac

SEQ ID NO: 1740 - DNA, 200 bp, Conyza canadensis
gtgggcttaaatccatcatctgggtcctcacttgttacacgtacagcaatacaatgaccttttgggctgatagactctgccttgtcaaagtcaaatggagttgcaagagcagatgttctcctccaagcatcgtatcctccactattgtccattccataaaatcgtcttatttctggtatttgccaaagaggaatgcccat

SEQ ID NO: 1741 - DNA, 200 bp, Conyza canadensis
acccagatgatggatttaagcccactagtggaaaagttcaggagctaagttttaaaagcaagccaaatgtctgggcatacttttctgtcaagtccggaggaggcattcatgaattctcagattctcaatttggccacgtttttgcatttggcgagtcaagacctttggctattgcaaatatggttcttgggctgaaggaa

SEQ ID NO: 1742 - DNA, 200 bp, Conyza canadensis
ttccttcagcccaagaaccatatttgcaatagccaaaggtcttgactcgccaaatgcaaaaacgtggccaaattgagaatctgagaattcatgaatgcctcctccggacttgacagaaaagtatgcccagacatttggcttgcttttaaaacttagctcctgaacttttccactagtgggcttaaatccatcatctgggt

SEQ ID NO: 1743 - DNA, 200 bp, Conyza canadensis
aaatatggttcttgggctgaaggaaattcaaattcgtggcgagatccgtacgaatgttgattatacaattgatctgttacatgctcctgattatagagaaaataaaatacataccggttggttagatagccgaattgctatgagggttagagcagaaaggcccccttggtatctttcagtagttgggggagcactttata

SEQ ID NO: 1744 - DNA, 200 bp, Conyza canadensis
tataaagtgctcccccaactactgaaagataccaagggggcctttctgctctaaccctcatagcaattcggctatctaaccaaccggtatgtattttattttctctataatcaggagcatgtaacagatcaattgtataatcaacattcgtacggatctcgccacgaatttgaatttccttcagcccaagaaccatattt

SEQ ID NO: 1745 - DNA, 200 bp, Conyza canadensis
tcagtagttgggggagcactttataaagctgctgctagaagtgcagccatggtctcggactatgttggttaccttgaaaagggccaaatccctcctaagcatatatcattggtcaactcacaagtttctttgaatattgagggcagcaaatacacgattgatatggtaaaaagagggccaggaagttacagattgagaat

SEQ ID NO: 1746 - DNA, 200 bp, Conyza canadensis
attctcaatctgtaacttcctggccctctttttaccatatcaatcgtgtatttgctgccctcaatattcaaagaaacttgtgagttgaccaatgatatatgcttaggagggatttggcccttttcaaggtaaccaacatagtccgagaccatggctgcacttctagcagcagctttataaagtgctcccccaactactga

SEQ ID NO: 1747 - DNA, 200 bp, Conyza canadensis
ggccaggaagttacagattgagaatgaatcaatccgagattgaagcagagatacatacactacgtgacggaggcttattgatgcagttggatgggaatagtcatatattatacgccgaggaagaagctgccggtactcgcttgcttattgatggacggacttgcttgcttcagaatgatcatgatccttccaagttgatg

SEQ ID NO: 1748 - DNA, 200 bp, Conyza canadensis
catcaacttggaaggatcatgatcattctgaagcaagcaagtccgtccatcaataagcaagcgagtaccggcagcttcttcctcggcgtataatatatgactattcccatccaactgcatcaataagcctccgtcacgtagtgtatgtatctctgcttcaatctcggattgattcattctcaatctgtaacttcctggcc

SEQ ID NO: 1749 - DNA, 200 bp, Conyza canadensis
tgatcatgatccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggctggtgagc

SEQ ID NO: 1750 - DNA, 200 bp, Conyza canadensis
gctcaccagcctgcatggcttgaccttctgacatcttgaattgtataactccagcagccggtgaaaggagtggcatacacatcttcataacttcaacctcagcatacggtgtgtcagcattaacatggctatcatctgagaccaagtaccttagaagtttgcatggtgtttcagccatcaacttggaaggatcatgatca

SEQ ID NO: 1751 - DNA, 200 bp, Conyza canadensis
ggtcaagccatgcaggctggtgagcttatagcaaggctagatcttgacgatccgtcagctgtaagaaaagcagagcctttcaatggaaactttcctcttcttgggcctccaacggccatgtcagacaaagtgcatcagaagtgtgctgcaactttaaatgctgctcgaatgattctcgcaggctatgatcataacattga

SEQ ID NO: 1752 - DNA, 200 bp, Conyza canadensis
tcaatgttatgatcatagcctgcgagaatcattcgagcagcatttaaagttgcagcacacttctgatgcactttgtctgacatggccgttggaggcccaagaagaggaaagtttccattgaaaggctctgcttttcttacagctgacggatcgtcaagatctagccttgctataagctcaccagcctgcatggcttgacc

SEQ ID NO: 1753 - DNA, 200 bp, Conyza canadensis
tcgcaggctatgatcataacattgatgaattggaatccaagtttaaggagtacgaaggaatttccacacaacaaactattgactttcctgctagagttctacgggtcattcttgaaacccatcttggatcttgctcagaaaaagaaaagggagcccaagaaaggctcgttgagccattaatgggtcttgtaaagtcatat

SEQ ID NO: 1754 - DNA, 200 bp, Conyza canadensis
atatgactttacaagacccattaatggctcaacgagcctttcttgggctcccttttctttttctgagcaagatccaagatgggtttcaagaatgacccgtagaactctagcaggaaagtcaatagtttgttgtgtggaaattccttcgtactccttaaacttggattccaattcatcaatgttatgatcatagcctgcga

SEQ ID NO: 1755 - DNA, 200 bp, Conyza canadensis
attaatgggtcttgtaaagtcatatgaagggggaagagaaagtcatgcacgtgggatcgttcatgctctatttgatgaatatttatctgttgaagagttgttcagcgacaacattcaggctgatgtaatcgaacgtcttcgacaactatacaagaaagatctcttgaggattgtcgacattgtcctttcccatcagggtg

SEQ ID NO: 1756 - DNA, 200 bp, Conyza canadensis
caccctgatgggaaaggacaatgtcgacaatcctcaagagatctttcttgtatagttgtcgaagacgttcgattacatcagcctgaatgttgtcgctgaacaactcttcaacagataaatattcatcaaatagagcatgaacgatcccacgtgcatgactttctcttcccccttcatatgactttacaagacccattaat

SEQ ID NO: 1757 - DNA, 200 bp, Conyza canadensis
gacattgtcctttcccatcagggtgttaggagtaaaaacaaattgatactacggctgatggagcatttggtttaccccaatccggctgcgtatagggagaaactgatacgattttctcaacttaaccacacaagttattctgagttagcactgaaggcaagtcaacttttagaacaaactaaactaagtgaacttcgttc

SEQ ID NO: 1758 - DNA, 200 bp, Conyza canadensis
gaacgaagttcacttagtttagtttgttctaaaagttgacttgccttcagtgctaactcagaataacttgtgtggttaagttgagaaaatcgtatcagtttctccctatacgcagccggattggggtaaaccaaatgctccatcagccgtagtatcaatttgtttttactcctaacaccctgatgggaaaggacaatgtc

SEQ ID NO: 1759 - DNA, 200 bp, Conyza canadensis
aaactaaactaagtgaacttcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaa

SEQ ID NO: 1760 - DNA, 200 bp, Conyza canadensis
ttgaagggtgtgatcgctatggtcaaaaagaccaacaagggcatcttcaactgccaatggagcactcacaatatcctccattctttcattaatggcactcttcctcttaggggtatccatattttcaccttcttcagtaaacatctctaattcagaaagacttcgcgcaatgcttgaacgaagttcacttagtttagttt

SEQ ID NO: 1761 - DNA, 200 bp, Conyza canadensis
tgaccatagcgatcacacccttcaaaggcgtgttgttgagacctatgttcgaagattatatcagccatatctcgtgaaggggagtgttagaatgcagtggcacagatccggactcatcgctacatggcaatttatagaaggactcattggagaagttaatgtgcctgactatgaacagaatgaagctcccttggaagaca

SEQ ID NO: 1762 - DNA, 200 bp, Conyza canadensis
tgtcttccaagggagcttcattctgttcatagtcaggcacattaacttctccaatgagtccttctataaattgccatgtagcgatgagtccggatctgtgccactgcattctaacactccccttcacgagatatggctgatataatcttcgaacataggtctcaacaacacgcctttgaagggtgtgatcgctatggtca

SEQ ID NO: 1763 - DNA, 200 bp, Conyza canadensis
cagaatgaagctcccttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagat

SEQ ID NO: 1764 - DNA, 200 bp, Conyza canadensis
atctggttatttatgccggccaaagcaatgtgcatcatattaccatggttactatgaccagcaaacccattctgacttgttctgggaaggttatgactcgtttctttaagagatgcacttatgacatcaggcaaaaattgaagagatttaataataaccatagctccccatttcttgtcttccaagggagcttcattctg

SEQ ID NO: 1765 - DNA, 200 bp, Conyza canadensis
ctttggccggcataaataaccagatgagtttgcttcaagacagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcac

SEQ ID NO: 1766 - DNA, 200 bp, Conyza canadensis
gtgaaatgagtgtctcatggggcctctcccttcatctctttgtattatacaactgatcactccataccctgcgtttttaagactcgagcttacttctttatctttgagtatttttgctaacctgttgactctctcttgagcctgatcctcatcaccactgtcttgaagcaaactcatctggttatttatgccggccaaag

SEQ ID NO: 1767 - DNA, 200 bp, Conyza canadensis
aggccccatgagacactcatttcactggtcagaagagaatcattattatattgaagagccattattgcgtcacttggagcctccattatcgacatatcttgaactggacaaacttaagggctatgataatataaagtacactccgtcgcgtgaccgtcaatggcacatgtatactgttgatgctaaaccacttccggtac

SEQ ID NO: 1768 - DNA, 200 bp, Conyza canadensis
gtaccggaagtggtttagcatcaacagtatacatgtgccattgacggtcacgcgacggagtgtactttatattatcatagcccttaagtttgtccagttcaagatatgtcgataatggaggctccaagtgacgcaataatggctcttcaatataataatgattctcttctgaccagtgaaatgagtgtctcatggggcct

SEQ ID NO: 1769 - DNA, 200 bp, Conyza canadensis
gttgatgctaaaccacttccggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttca

SEQ ID NO: 1770 - DNA, 200 bp, Conyza canadensis
tgaacatgaagttccaactcctccatagccgtcactaatgatctcaagatgctccttgatgtaaaagggagatttaactgagaccgtgggccctcatcttctgaaccttggtaacctgagggcgagaaccattcctttgttggatgccttataagagttctaagaaacattctttgtaccggaagtggtttagcatcaac

SEQ ID NO: 1771 - DNA, 200 bp, Conyza canadensis
tggaggagttggaacttcatgttcataatgctactgtcaagtctgaccatgctcatatgtacctatatgtattgaaggagcaacaaattggtgatcttgttccatacacaacgagagtggatgtagattctgggacagaagattgcgtggttgagacacttttggtaaggctggctcgtgaaatccattcaatggttggt

SEQ ID NO: 1772 - DNA, 200 bp, Conyza canadensis
accaaccattgaatggatttcacgagccagccttaccaaaagtgtctcaaccacgcaatcttctgtcccagaatctacatccactctcgttgtgtatggaacaagatcaccaatttgttgctccttcaatacatataggtacatatgagcatggtcagacttgacagtagcattatgaacatgaagttccaactcctcca

SEQ ID NO: 1773 - DNA, 200 bp, Conyza canadensis
tcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtatatcgtgaactggaagatactggtttgcacaaggtgtatcatgcta

SEQ ID NO: 1774 - DNA, 200 bp, Conyza canadensis
tagcatgatacaccttgtgcaaaccagtatcttccagttcacgatatacatgcacaacgcaggtatgaccagtcacatttgtgaccacaaccctccacgcaccgttggcttgacccgatgatgccatgcaaagcttcacctcccactcaaaaactcccaaccggtgcatctttacaccaaccattgaatggatttcacga

SEQ ID NO: 1775 - DNA, 200 bp, Conyza canadensis
ggtttgcacaaggtgtatcatgctacctctacattgggtcctttgcatggcgtacctgtgaatacaccctttcagcctttaggattacttgatcagaagcgtcttttggcaaggaaaagcaatactacgtactgctacgactttgcactggcatttgaagcagctcttgagaatatctgggcgtcgaaagtcgtaagtga

SEQ ID NO: 1776 - DNA, 200 bp, Conyza canadensis
tcacttacgactttcgacgcccagatattctcaagagctgcttcaaatgccagtgcaaagtcgtagcagtacgtagtattgcttttccttgccaaaagacgcttctgatcaagtaatcctaaaggctgaaagggtgtattcacaggtacgccatgcaaaggacccaatgtagaggtagcatgatacaccttgtgcaaacc

SEQ ID NO: 1777 - DNA, 200 bp, Conyza canadensis
tctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgatt

SEQ ID NO: 1778 - DNA, 200 bp, Conyza canadensis
aatcgttcttccatcaggaaactcaggagtgcagaggtccatagtccacgccaccatgcccaccttgttttgccctggctcacgatttactgcaacaaggggagttccccatgagccacttggctcagcaaacatgagctccgtcacattcacaagtttacccttaggcctgctatcacttacgactttcgacgcccaga

SEQ ID NO: 1779 - DNA, 200 bp, Conyza canadensis
tgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaa

SEQ ID NO: 1780 - DNA, 200 bp, Conyza canadensis
ttctaaagcaagatctgacttcctcagccgctccgatacgggcccccgagtttgctgccaagtatattagtggcagtttcttggcacaagcgagatcagtaactgcctcaaaaaaggcatcctcaagaggaccaaaagatccatttttgaacgtaacatcgtttgctactaccaaaatcgttcttccatcaggaaactca

SEQ ID NO: 1781 - DNA, 200 bp, Conyza canadensis
gaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttga

SEQ ID NO: 1782 - DNA, 200 bp, Conyza canadensis
tcaaccccgagtccgtcttcttttcccacaatagtatcgatgacatatcttgtttcgccatttgatagatgaacctcatgagctattacagatgatttgatgtgggtataatcttcaggagtaagatacaaatactggaatcccgattcaggagtcgactcatcagaccacccaattctaaagcaagatctgacttcctc

SEQ ID NO: 1783 - DNA, 200 bp, Conyza canadensis
gaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgca

SEQ ID NO: 1784 - DNA, 200 bp, Conyza canadensis
tgcagaaaaacccgttaatataatcggttgatcaagccgctgtatgcaccgcatcccaagacgtgccagatatgcgcctatcccaactgttcttccagtaacatatgttaatgtaaacgtttccttatatgctttcgaataggcaccagcaattgccccgctaccactcaaattttcaaccccgagtccgtcttcttttc

SEQ ID NO: 1785 - DNA, 200 bp, Conyza canadensis
gattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctg

SEQ ID NO: 1786 - DNA, 200 bp, Conyza canadensis
caggaagtgggccaccgacataaggtggaacaaagctcaaccaattcaagatagctgagacaccttcgagatcatcggacaccgttaaatggacaacaccattcgtagccataattttaggcccacctagttgcatctgtgagctataaacctctcggcccaaaagcttgttcagtgcagaaaaacccgttaatataatc

SEQ ID NO: 1787 - DNA, 200 bp, Conyza canadensis
ccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaac

SEQ ID NO: 1788 - DNA, 200 bp, Conyza canadensis
gttacgactgtcctcgcccaaccttccaatgtctccacaaaactgtctctatcgaaaatcccaccagcccattcaccgttgctatccacgaccccacaaatagctgcccgaggatcacatgagttttcagggaggtactcaacgggcctttctggtggatccacaggtgctaaaacaggaagtgggccaccgacataagg

SEQ ID NO: 1789 - DNA, 200 bp, Conyza canadensis
aaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatg

SEQ ID NO: 1790 - DNA, 200 bp, Conyza canadensis
catcaatgcctgagctgttttgctggcggaatccgggaaccagacctgacctgcttgaggaacaacacgttcgtgtgaatcaagctgcccgggatctgcaggtatttcttgcatcactgtttgtgtctcaacagcaacgatcccgactgggatcccgccaagtttggcacgacccgttacgactgtcctcgcccaacctt

SEQ ID NO: 1791 - DNA, 200 bp, Conyza canadensis
cagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtg

SEQ ID NO: 1792 - DNA, 200 bp, Conyza canadensis
cacgaagttctccagttttcgggatgtatacaaaaacaggctggttatatgttctgagattctcaacaattgttgaccctgcttgtaaaatcccttcaaaaagatcccgctgacctgcagaaaagcctcgccagttagccatgatgaaaagtgggagctcttctcggttgaaatccatcaatgcctgagctgttttgctg

SEQ ID NO: 1793 - DNA, 200 bp, Conyza canadensis
atcccgaaaactggagaacttcgtggcggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaa

SEQ ID NO: 1794 - DNA, 200 bp, Conyza canadensis
ttaaggcttcgaatctgtggatctagacgacccatacagtctatcaattctttgtttcggaacttaatctcaatcataccttcaggttcaaggacatttccttttgctgtggtttctgcatacatttctatatgatctgaattgattcgactgtcgacaaccacccatgcaccgccacgaagttctccagttttcgggat

SEQ ID NO: 1795 - DNA, 200 bp, Conyza canadensis
tagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagta

SEQ ID NO: 1796 - DNA, 200 bp, Conyza canadensis
tactttccagtcaacaacttgtttgaccacacctttttcagccattcgcaatgatgtgtcatgaagttcagcgaatttggtagcaatttgagtgtaaatcggtaaaagctgtttttcacgagattttatctgttggacgatcgtttgatcgtactttgtttctcgaagtctttctttaaggcttcgaatctgtggatcta

SEQ ID NO: 1797 - DNA, 200 bp, Conyza canadensis
caaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttt

SEQ ID NO: 1798 - DNA, 200 bp, Conyza canadensis
aaaaagcatcatcactaagccataaatcttcagttttcgattccaaaaaccatttcttaatcaactcatgagcagacttgtaggaaagagtatcaccagcagcttcacgagcactactgatcaaggaagcctctgcgagcctacgacgaagccttttgtaaaagaaaaaccgagatactttccagtcaacaacttgtttg

SEQ ID NO: 1799 - DNA, 200 bp, Conyza canadensis
ttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtgaacaaactctcttttattttccctta

SEQ ID NO: 1800 - DNA, 200 bp, Conyza canadensis
taagggaaaataaaagagagtttgttcacctcttgcaaaagtgcggcgaggccttgtggtaaagcttgtagatccaatggtgaattaccaatctttaataactgatccaagagcttctgagtacgtagcttggctaacttgtcattatagttcatcagattgtctttccaagtgaaaaaagcatcatcactaagccataa

SEQ ID NO: 1801 - DNA, 200 bp, Conyza canadensis
atgccagaagctcaaagaatgcctctaaatggaagccttaatcttggtaatggttatgtaaatggggccatttcattgaggtcttctgctagcagatctgccattgatgaattttgtaatgcacttggggggaataggccaatccatagtattttaattgcaaacaatggaatggctgctgtaaagtttataagaagtgt

SEQ ID NO: 1802 - DNA, 200 bp, Conyza canadensis
acacttcttataaactttacagcagccattccattgtttgcaattaaaatactatggattggcctattccccccaagtgcattacaaaattcatcaatggcagatctgctagcagaagacctcaatgaaatggccccatttacataaccattaccaagattaaggcttccatttagaggcattctttgagcttctggcat

SEQ ID NO: 1803 - DNA, 200 bp, Conyza canadensis
ctgctgtaaagtttataagaagtgtgaggacatggagttatgaaacgtttggttcagaaaaagcaattttgttggtagccatggctacacctgaggatatgaggattaatgccgagcatattagaattgctgatcagtttgttgaagtcccaggtggtacaaataataataattatgctaatgtgcagctcatcgtggag

SEQ ID NO: 1804 - DNA, 200 bp, Conyza canadensis
ctccacgatgagctgcacattagcataattattattatttgtaccacctgggacttcaacaaactgatcagcaattctaatatgctcggcattaatcctcatatcctcaggtgtagccatggctaccaacaaaattgctttttctgaaccaaacgtttcataactccatgtcctcacacttcttataaactttacagcag

SEQ ID NO: 1805 - DNA, 200 bp, Conyza canadensis
tgctaatgtgcagctcatcgtggagactgctgagataacacatgttgatgctgtttggcctggttggggtcatgcctctgaaattcctgaattacctgatgcattggacgcaaagggaattgtatttcttgggccgccggcttcatccatggcggctttaggagacaaaatcggctcttctttaattgcacaagctgctg

SEQ ID NO: 1806 - DNA, 200 bp, Conyza canadensis
cagcagcttgtgcaattaaagaagagccgattttgtctcctaaagccgccatggatgaagccggcggcccaagaaatacaattccctttgcgtccaatgcatcaggtaattcaggaatttcagaggcatgaccccaaccaggccaaacagcatcaacatgtgttatctcagcagtctccacgatgagctgcacattagca

SEQ ID NO: 1807 - DNA, 200 bp, Conyza canadensis
tcttctttaattgcacaagctgctgacgtgccaacacttccttggagtggttctcatgtgaaaatttctgcagagagctgcttagacacaattccagatgacgtatatagaaaagcttgtgtccatacaaccgaggaagcagttgcttcttgtcaagttattggttatcctgctatgatcaaggcatcatggggcggtgg

SEQ ID NO: 1808 - DNA, 200 bp, Conyza canadensis
ccaccgccccatgatgccttgatcatagcaggataaccaataacttgacaagaagcaactgcttcctcggttgtatggacacaagcttttctatatacgtcatctggaattgtgtctaagcagctctctgcagaaattttcacatgagaaccactccaaggaagtgttggcacgtcagcagcttgtgcaattaaagaaga

SEQ ID NO: 1809 - DNA, 200 bp, Conyza canadensis
tgatcaaggcatcatggggcggtggtggcaaaggcataagaaaggtgcatagtgatgaagaagtcaagacactttttaagcaagttcagggtgaagtccctggttcccccatatttattatgaaagttgcttcccagagccgacatctagaagtacaactcctctgtgatcagcatggcaatgtagcggctttacatagt

SEQ ID NO: 1810 - DNA, 200 bp, Conyza canadensis
actatgtaaagccgctacattgccatgctgatcacagaggagttgtacttctagatgtcggctctgggaagcaactttcataataaatatgggggaaccagggacttcaccctgaacttgcttaaaaagtgtcttgacttcttcatcactatgcacctttcttatgcctttgccaccaccgccccatgatgccttgatca

SEQ ID NO: 1811 - DNA, 200 bp, Conyza canadensis
tggcaatgtagcggctttacatagtcgggattgcagtgttcaaaggcggcatcaaaagattatcgaggaggggccaataaccatagccccccctgacacaataaaaaaattggagcaagcggcaagaagattagccaaatcggtcaattatgttggagctgcaactgtagagtatttgtacagtatggaaaccggagatt

SEQ ID NO: 1812 - DNA, 200 bp, Conyza canadensis
aatctccggtttccatactgtacaaatactctacagttgcagctccaacataattgaccgatttggctaatcttcttgccgcttgctccaatttttttattgtgtcagggggggctatggttattggcccctcctcgataatcttttgatgccgcctttgaacactgcaatcccgactatgtaaagccgctacattgcca

SEQ ID NO: 1813 - DNA, 200 bp, Conyza canadensis
ttgtacagtatggaaaccggagattattactttttggagctcaatccccgtttacaggttgagcatcctgtcactgagtggatagcggaagttaatctacctgcagcacaagttgcggttggaatgggcattccactttggcaaattcccgaaataagacggttttatggaaaggaaaacggtggagggtatgatgcttg

SEQ ID NO: 1814 - DNA, 200 bp, Conyza canadensis
caagcatcataccctccaccgttttcctttccataaaaccgtcttatttcgggaatttgccaaagtggaatgcccattccaaccgcaacttgtgctgcaggtagattaacttccgctatccactcagtgacaggatgctcaacctgtaaacggggattgagctccaaaaagtaataatctccggtttccatactgtacaa

SEQ ID NO: 1815 - DNA, 200 bp, Conyza canadensis
aaaacggtggagggtatgatgcttggaggagaacatcggttcttgcaaccccatttgattttgatcgcgccgagtcagttaggccgaagggtcattgtgttgctgtacgtgtaacaagtgaagatccggatgatggttttaagcccaccagtggaaaagttcaggagctaagttttaaaagcaagccaaacgtatgggca

SEQ ID NO: 1816 - DNA, 200 bp, Conyza canadensis
tgcccatacgtttggcttgcttttaaaacttagctcctgaacttttccactggtgggcttaaaaccatcatccggatcttcacttgttacacgtacagcaacacaatgacccttcggcctaactgactcggcgcgatcaaaatcaaatggggttgcaagaaccgatgttctcctccaagcatcataccctccaccgtttt

SEQ ID NO: 1817 - DNA, 200 bp, Conyza canadensis
taaaagcaagccaaacgtatgggcatacttttctgtcaagtctggaggaggcattcatgaattctcagattctcaattcggtcatgtttttgcatttggagagtcaagaacattggctattgcaaatatggttcttgggctaaaggaaattcaaattcgtggcgaaatgcgcactaatgttgattatacaattgatttat

SEQ ID NO: 1818 - DNA, 200 bp, Conyza canadensis
ataaatcaattgtataatcaacattagtgcgcatttcgccacgaatttgaatttcctttagcccaagaaccatatttgcaatagccaatgttcttgactctccaaatgcaaaaacatgaccgaattgagaatctgagaattcatgaatgcctcctccagacttgacagaaaagtatgcccatacgtttggcttgctttta

SEQ ID NO: 1819 - DNA, 200 bp, Conyza canadensis
aatgttgattatacaattgatttattacatgctccagattatagagaaaacaaaatacacacgggttggttagatagccgaattgcgatgcgggttagagcagaaaggcctccttggtatctttcggtagtggggggagctctttacaaagccgctgctagaagtgcagccatggcctctgactatgttggttatcttga

SEQ ID NO: 1820 - DNA, 200 bp, Conyza canadensis
tcaagataaccaacatagtcagaggccatggctgcacttctagcagcggctttgtaaagagctccccccactaccgaaagataccaaggaggcctttctgctctaacccgcatcgcaattcggctatctaaccaacccgtgtgtattttgttttctctataatctggagcatgtaataaatcaattgtataatcaacatt

SEQ ID NO: 1821 - DNA, 200 bp, Conyza canadensis
cctctgactatgttggttatcttgaaaaggggcaaatccctccaaagcatttatcactagtcaactctcaagttactttgaatattgaggggagcagatacacaattgatatggtaaaaagaggacctggaggttatagattgaaaatgaaccaatctgagattgaagcagaaatacatactctacgtgacgggggttta

SEQ ID NO: 1822 - DNA, 200 bp, Conyza canadensis
taaacccccgtcacgtagagtatgtatttctgcttcaatctcagattggttcattttcaatctataacctccaggtcctctttttaccatatcaattgtgtatctgctcccctcaatattcaaagtaacttgagagttgactagtgataaatgctttggagggatttgccccttttcaagataaccaacatagtcagagg

SEQ ID NO: 1823 - DNA, 200 bp, Conyza canadensis
acatactctacgtgacgggggtttattgatgcagttggatgggaatagtcatattatatatgctgaagaagaagccgctggtactcgtctcctcattgatggacggacatgtttgcttcagaatgatcatgatccttccaagctggtggccgaaacaccatgcaaacttctaagatacttagtctcagatagtagccatg

SEQ ID NO: 1824 - DNA, 200 bp, Conyza canadensis
catggctactatctgagactaagtatcttagaagtttgcatggtgtttcggccaccagcttggaaggatcatgatcattctgaagcaaacatgtccgtccatcaatgaggagacgagtaccagcggcttcttcttcagcatatataatatgactattcccatccaactgcatcaataaacccccgtcacgtagagtatgt

SEQ ID NO: 1825 - DNA, 200 bp, Conyza canadensis
tacttagtctcagatagtagccatgtcgatgctgacacaccttatgctgaggtggaggtaatgaagatgtgtatgccgctactttcgccggcttctggagttatacagtttaagatgtctgaaggtcaagcaatgcatgctggtgagctaatagcaaggcttgatcttgatgacccatcagcagtaagaaaagcagagcc

SEQ ID NO: 1826 - DNA, 200 bp, Conyza canadensis
ggctctgcttttcttactgctgatgggtcatcaagatcaagccttgctattagctcaccagcatgcattgcttgaccttcagacatcttaaactgtataactccagaagccggcgaaagtagcggcatacacatcttcattacctccacctcagcataaggtgtgtcagcatcgacatggctactatctgagactaagta

SEQ ID NO: 1827 - DNA, 200 bp, Conyza canadensis
catcagcagtaagaaaagcagagcctttccatggaacttttcctcttcttgggtcttcaactgccatgtcagataaagttcatcaaaagtgtgctacaactctaagtgccgctcgaatgattcttgcaggctatgatcacgatattgatgaattggaaacaaaatttaaggagtacgaaggaatttccacccaacaagct

SEQ ID NO: 1828 - DNA, 200 bp, Conyza canadensis
agcttgttgggtggaaattccttcgtactccttaaattttgtttccaattcatcaatatcgtgatcatagcctgcaagaatcattcgagcggcacttagagttgtagcacacttttgatgaactttatctgacatggcagttgaagacccaagaagaggaaaagttccatggaaaggctctgcttttcttactgctgatg

SEQ ID NO: 1829 - DNA, 200 bp, Conyza canadensis
cgaaggaatttccacccaacaagctattgatttccccgccaaattattatggggaattcttgaaacacatcttgaattgtgctcggaaaaggaaaggggagcccaagaaaggcttgctgagccattaatgagtcttgtcaagtcctatgaaggtggcagagagagtcatgcacgtgggatcgttcatgctctttttgaag

SEQ ID NO: 1830 - DNA, 200 bp, Conyza canadensis
cttcaaaaagagcatgaacgatcccacgtgcatgactctctctgccaccttcataggacttgacaagactcattaatggctcagcaagcctttcttgggctcccctttccttttccgagcacaattcaagatgtgtttcaagaattccccataataatttggcggggaaatcaatagcttgttgggtggaaattccttcg

SEQ ID NO: 1831 - DNA, 200 bp, Conyza canadensis
gggatcgttcatgctctttttgaagcatatttatctgttgaagagctatttagcgacaacattcaggctgatgtaattgaacgtcttagacaacaatacaagaaggatctgtcgagggttgttgacatcgtgatttcacatcagggtgttaagactaaaaacaaactgatactacgactgatggagcatttggtttaccc

SEQ ID NO: 1832 - DNA, 200 bp, Conyza canadensis
gggtaaaccaaatgctccatcagtcgtagtatcagtttgtttttagtcttaacaccctgatgtgaaatcacgatgtcaacaaccctcgacagatccttcttgtattgttgtctaagacgttcaattacatcagcctgaatgttgtcgctaaatagctcttcaacagataaatatgcttcaaaaagagcatgaacgatccc

SEQ ID NO: 1833 - DNA, 200 bp, Conyza canadensis
gactgatggagcatttggtttaccctaatccagccgcctatagggaaaatctgatacggttttctcaattgaaccacactagttattctgagttagcattgaaggcaagtcagctgctagaacagactaaactgagtgaacttcgttcaagcatagctagaagtctttctgagttagagatgtttaccgaagaaggtgag

SEQ ID NO: 1834 - DNA, 200 bp, Conyza canadensis
ctcaccttcttcggtaaacatctctaactcagaaagacttctagctatgcttgaacgaagttcactcagtttagtctgttctagcagctgacttgccttcaatgctaactcagaataactagtgtggttcaattgagaaaaccgtatcagattttccctataggcggctggattagggtaaaccaaatgctccatcagtc

SEQ ID NO: 1835 - DNA, 200 bp, Conyza canadensis
agagatgtttaccgaagaaggtgagaatatagatacccctaagaggaagagtgccattgatgaaagaatggaggatattgtgagtgctcctttggcggtcgaagatgcccttgttggtctttttgatcacagtgatcacacccttcaaaggcgtgttgttgagacctatgttcgaaggctatatcagccatatctcgtga

SEQ ID NO: 1836 - DNA, 200 bp, Conyza canadensis
tcacgagatatggctgatatagccttcgaacataggtctcaacaacacgcctttgaagggtgtgatcactgtgatcaaaaagaccaacaagggcatcttcgaccgccaaaggagcactcacaatatcctccattctttcatcaatggcactcttcctcttaggggtatctatattctcaccttcttcggtaaacatctct

SEQ ID NO: 1837 - DNA, 200 bp, Conyza canadensis
aggctatatcagccatatctcgtgaagaggagtgttaagatgcagtggcacagatccggacttattgcttcatggcaattcatggaaggacacgctgaagctgttaatgtgtctgattatgaaactattgatacacaattggtagataagaaatggggagctatggttattattagatctcttcaatttttacctgatgt

SEQ ID NO: 1838 - DNA, 200 bp, Conyza canadensis
acatcaggtaaaaattgaagagatctaataataaccatagctccccatttcttatctaccaattgtgtatcaatagtttcataatcagacacattaacagcttcagcgtgtccttccatgaattgccatgaagcaataagtccggatctgtgccactgcatcttaacactcctcttcacgagatatggctgatatagcct

SEQ ID NO: 1839 - DNA, 200 bp, Conyza canadensis
gatctcttcaatttttacctgatgtcataagtgcagctcttaaagaaactacttataaacatcatggcacaagtcaaaatggggatgccaatccaagttatcaaggttatatgatgcatattgcattggtaggcatcaacaaccaaatgagtttgcttcaagacagtggtgatgaggatcaggctcaagagagagtcaac

SEQ ID NO: 1840 - DNA, 200 bp, Conyza canadensis
gttgactctctcttgagcctgatcctcatcaccactgtcttgaagcaaactcatttggttgttgatgcctaccaatgcaatatgcatcatataaccttgataacttggattggcatccccattttgacttgtgccatgatgtttataagtagtttctttaagagctgcacttatgacatcaggtaaaaattgaagagatc

SEQ ID NO: 1841 - DNA, 200 bp, Conyza canadensis
ggatcaggctcaagagagagtcaacaagttagcaaaaatactcaaagataaagaaataagtgtgaaactaaaaaatgcaggatatgaagttgtaagttgcataatacaaagagacgaaggtagaggcccggtgagacactcatttcactggtcagaaaagaatcgttattatatcgaagagccatcattgcgtcatttgg

SEQ ID NO: 1842 - DNA, 200 bp, Conyza canadensis
ccaaatgacgcaatgatggctcttcgatataataacgattcttttctgaccagtgaaatgagtgtctcaccgggcctctaccttcgtctctttgtattatgcaacttacaacttcatatcctgcattttttagtttcacacttatttctttatctttgagtatttttgctaacttgttgactctctcttgagcctgatcc

SEQ ID NO: 1843 - DNA, 200 bp, Conyza canadensis
gaagagccatcattgcgtcatttggagcctccattatcgatttatcttgaactggacaagcttaagggctatgagaatgtaaagtacactccatcacgtgaccgtcaatggcacatgtatactgttgatgctaaaccacttccggttcaaagaatgtttcttagaacgcttgtaaggcacccgacaaaagaatggttctt

SEQ ID NO: 1844 - DNA, 200 bp, Conyza canadensis
aagaaccattcttttgtcgggtgccttacaagcgttctaagaaacattctttgaaccggaagtggtttagcatcaacagtatacatgtgccattgacggtcacgtgatggagtgtactttacattctcatagcccttaagcttgtccagttcaagataaatcgataatggaggctccaaatgacgcaatgatggctcttc

SEQ ID NO: 1845 - DNA, 200 bp, Conyza canadensis
ggcacccgacaaaagaatggttcttgccctcaggataccaagattcggaagttgtggacccacggtctcagttaactttaccttttacatcaaggagcatcttgagatctttagtgaccgccatggaggagttggaacttcatgttcataatgctatagtcaagtcggaccatgctcatatgtacctctatatattgaaa

SEQ ID NO: 1846 - DNA, 200 bp, Conyza canadensis
tttcaatatatagaggtacatatgagcatggtccgacttgactatagcattatgaacatgaagttccaactcctccatggcggtcactaaagatctcaagatgctccttgatgtaaaaggtaaagttaactgagaccgtgggtccacaacttccgaatcttggtatcctgagggcaagaaccattcttttgtcgggtgcc

SEQ ID NO: 1847 - DNA, 200 bp, Conyza canadensis
tcatatgtacctctatatattgaaagaacaacaaataaatgatcttgttccatatactaagagagtggatgtagattctggtaaagaagaaggtgtggttgagacgcttttggtgaagttggtccgtgaacttcattcgatggttggggtaaagatgcaccggttaggtgtttttgagtgggaggtgaagctttgtatgg

SEQ ID NO: 1848 - DNA, 200 bp, Conyza canadensis
ccatacaaagcttcacctcccactcaaaaacacctaaccggtgcatctttaccccaaccatcgaatgaagttcacggaccaacttcaccaaaagcgtctcaaccacaccttcttctttaccagaatctacatccactctcttagtatatggaacaagatcatttatttgttgttctttcaatatatagaggtacatatga

SEQ ID NO: 1849 - DNA, 200 bp, Conyza canadensis
gagtgggaggtgaagctttgtatggtatcatctggtgaagccaacggtgtttggagggtggtggtcacaaatgtgactgggcatacctgcaatgtacatgtgtatcgggaagtagaagatactgttaaacacaaggcagtgtatcatgctccctctacattgggacctttacatggtgtgctggtgaacacaccctttca

SEQ ID NO: 1850 - DNA, 200 bp, Conyza canadensis
tgaaagggtgtgttcaccagcacaccatgtaaaggtcccaatgtagagggagcatgatacactgccttgtgtttaacagtatcttctacttcccgatacacatgtacattgcaggtatgcccagtcacatttgtgaccaccaccctccaaacaccgttggcttcaccagatgataccatacaaagcttcacctcccactc

SEQ ID NO: 1851 - DNA, 200 bp, Conyza canadensis
gtgtgctggtgaacacaccctttcagcctctgggattactcgatcagaagcgtcttgtcgccaggaaaagcaatactacttactgctacgactttgcactggcatttgaagcagcccttgagaatatctggtcatcaaaactgcctggtgtaagcaggcccaagggcaaacttgtaaatgcgatggagcttgtgtttgct

SEQ ID NO: 1852 - DNA, 200 bp, Conyza canadensis
agcaaacacaagctccatcgcatttacaagtttgcccttgggcctgcttacaccaggcagttttgatgaccagatattctcaagggctgcttcaaatgccagtgcaaagtcgtagcagtaagtagtattgcttttcctggcgacaagacgcttctgatcgagtaatcccagaggctgaaagggtgtgttcaccagcacac

SEQ ID NO: 1853 - DNA, 200 bp, Conyza canadensis
aaatgcgatggagcttgtgtttgctgaccgaagaggtttatggggcactccacttgtgccagtaacgcgcgagcctggacaaaataatgtgggaatggtagcgtggactatggacctctgcacaccagaatttcctgatggtaggacgattttagttgtttcaaatgacgtcacatttaaaaacggatcttttggtccta

SEQ ID NO: 1854 - DNA, 200 bp, Conyza canadensis
taggaccaaaagatccgtttttaaatgtgacgtcatttgaaacaactaaaatcgtcctaccatcaggaaattctggtgtgcagaggtccatagtccacgctaccattcccacattattttgtccaggctcgcgcgttactggcacaagtggagtgccccataaacctcttcggtcagcaaacacaagctccatcgcattt

SEQ ID NO: 1855 - DNA, 200 bp, Conyza canadensis
tttaaaaacggatcttttggtcctatcgaggatgcgttttttgaggcagtcactgagcttgcttgtgccaaaaaactgccgctcatttacctggcggcaaactcaggggcccgtatcggggtggccgaagaggtcagatccagctttagaattgggtggtctgatgagtcaactcccgactccggctttcagtatttgta

SEQ ID NO: 1856 - DNA, 200 bp, Conyza canadensis
tacaaatactgaaagccggagtcgggagttgactcatcagaccacccaattctaaagctggatctgacctcttcggccaccccgatacgggcccctgagtttgccgccaggtaaatgagcggcagttttttggcacaagcaagctcagtgactgcctcaaaaaacgcatcctcgataggaccaaaagatccgtttttaaa

SEQ ID NO: 1857 - DNA, 200 bp, Conyza canadensis
ccgactccggctttcagtatttgtatctaactcccgaagattactctcgtttggaatcatcagtaatagcacatgaaattcgtctatccagtggtgaaacaagatgggtcattgatactattgtcgggaaagaggatggattaggggttgagaatttgagtggtagtggggcgattgctggggctttttcgaaggcatat

SEQ ID NO: 1858 - DNA, 200 bp, Conyza canadensis
atatgccttcgaaaaagccccagcaatcgccccactaccactcaaattctcaacccctaatccatcctctttcccgacaatagtatcaatgacccatcttgtttcaccactggatagacgaatttcatgtgctattactgatgattccaaacgagagtaatcttcgggagttagatacaaatactgaaagccggagtcgg

SEQ ID NO: 1859 - DNA, 200 bp, Conyza canadensis
tgctggggctttttcgaaggcatataaagaaacttttactttaacctacgtgactggaagaactgttgggataggtgcatatctggcccgtcttgggatgcgatgcatacaaaggcttgatcaaccgattattttaactgggttttctgcactaaacaagcttttgggccgagaggtttatagttcgcagatgcaacttg

SEQ ID NO: 1860 - DNA, 200 bp, Conyza canadensis
caagttgcatctgcgaactataaacctctcggcccaaaagcttgtttagtgcagaaaacccagttaaaataatcggttgatcaagcctttgtatgcatcgcatcccaagacgggccagatatgcacctatcccaacagttcttccagtcacgtaggttaaagtaaaagtttctttatatgccttcgaaaaagccccagca

SEQ ID NO: 1861 - DNA, 200 bp, Conyza canadensis
gtttatagttcgcagatgcaacttggtggacctaaaattatggccacgaatggcgttgttcatcaaactgtatctgatgatttggaaggtgtctcggctatcttgaactggttgagctatgttccgccttacgttggcggtccacttcctgttttgccacccatggatccaccagacaggcccgtcgagtacctgcctga

SEQ ID NO: 1862 - DNA, 200 bp, Conyza canadensis
tcaggcaggtactcgacgggcctgtctggtggatccatgggtggcaaaacaggaagtggaccgccaacgtaaggcggaacatagctcaaccagttcaagatagccgagacaccttccaaatcatcagatacagtttgatgaacaacgccattcgtggccataattttaggtccaccaagttgcatctgcgaactataaac

SEQ ID NO: 1863 - DNA, 200 bp, Conyza canadensis
acaggcccgtcgagtacctgcctgaaaactcatgtgatcctagggcagccatttgtgggaccgtggatggtaacgggaaatgggttggtgggattttcgacagaaacagttttgtggagacgttggaaggttgggcaaggacagttgtaacaggtcgggcgaaactcggtggaatccctgtgggggttgttgctgtcgag

SEQ ID NO: 1864 - DNA, 200 bp, Conyza canadensis
ctcgacagcaacaacccccacagggattccaccgagtttcgcccgacctgttacaactgtccttgcccaaccttccaacgtctccacaaaactgtttctgtcgaaaatcccaccaacccatttcccgttaccatccacggtcccacaaatggctgccctaggatcacatgagttttcaggcaggtactcgacgggcctgt

SEQ ID NO: 1865 - DNA, 200 bp, Conyza canadensis
ccctgtgggggttgttgctgtcgagacacaaacgatgatgcaagttatacctgcggatcctgggcagctcgattcacatgaacgtgtagttcctcaagctgggcaggtctggttcccggattctgctagtaagacagctcaagcgctgatggattttaatcgagaagagctcccccttttcattatggcaaactggcgag

SEQ ID NO: 1866 - DNA, 200 bp, Conyza canadensis
ctcgccagtttgccataatgaaaagggggagctcttctcgattaaaatccatcagcgcttgagctgtcttactagcagaatccgggaaccagacctgcccagcttgaggaactacacgttcatgtgaatcgagctgcccaggatccgcaggtataacttgcatcatcgtttgtgtctcgacagcaacaacccccacaggg

SEQ ID NO: 1867 - DNA, 200 bp, Conyza canadensis
cttttcattatggcaaactggcgagggttttcagccggtcaacgtgacctttttgaagggattctacaagcgggatcgacaattgtagagaatcttagaacctataaacagccagtttttgtctacattccaaaaacaggtgagcttcgaggtggtgcatgggtggtcgttgacagtcgaatcaattcagaccatataga

SEQ ID NO: 1868 - DNA, 200 bp, Conyza canadensis
tctatatggtctgaattgattcgactgtcaacgaccacccatgcaccacctcgaagctcacctgtttttggaatgtagacaaaaactggctgtttataggttctaagattctctacaattgtcgatcccgcttgtagaatcccttcaaaaaggtcacgttgaccggctgaaaaccctcgccagtttgccataatgaaaag

SEQ ID NO: 1869 - DNA, 200 bp, Conyza canadensis
gtcgaatcaattcagaccatatagaaatgtatgcagaaacaactgcgaaaggaaatgttcttgaacccgaaggtatgattgaaataaagttccgaaataaagagctggtagactgcatgggtcgattggacccactaatttgcaatctaaaagaaaaacttaaagaaacgaagctcgatcaagcaatcacccagcagata

SEQ ID NO: 1870 - DNA, 200 bp, Conyza canadensis
tatctgctgggtgattgcttgatcgagcttcgtttctttaagtttttcttttagattgcaaattagtgggtccaatcgacccatgcagtctaccagctctttatttcggaactttatttcaatcataccttcgggttcaagaacatttcctttcgcagttgtttctgcatacatttctatatggtctgaattgattcgac

SEQ ID NO: 1871 - DNA, 200 bp, Conyza canadensis
cgatcaagcaatcacccagcagataaaagcccgtgagaaacagcttttaccaatttacactcaaatcgctacaaagtttgctgaacttcatgacacatcattccgaatggctgaaaaaggtgttgtcaaaaaggttgttgactgggcaatttcccggtttttcttctacaaaagactccagcgtaggctggccgaggctt

SEQ ID NO: 1872 - DNA, 200 bp, Conyza canadensis
aagcctcggccagcctacgctggagtcttttgtagaagaaaaaccgggaaattgcccagtcaacaacctttttgacaacacctttttcagccattcggaatgatgtgtcatgaagttcagcaaactttgtagcgatttgagtgtaaattggtaaaagctgtttctcacgggcttttatctgctgggtgattgcttgatcg

SEQ ID NO: 1873 - DNA, 200 bp, Conyza canadensis
ctccagcgtaggctggccgaggcttctctaatcaagagtgctcgtgatgctgctggtgacacgctttcacacaaatctgctcatgaaatgatcaaaaaatggtttttggacacaaaaagtgaagatatgtgggtgaatgacgacgcctttttcacatggaaagatgatccattgaactatactagcaaattagccgatct

SEQ ID NO: 1874 - DNA, 200 bp, Conyza canadensis
agatcggctaatttgctagtatagttcaatggatcatctttccatgtgaaaaaggcgtcgtcattcacccacatatcttcactttttgtgtccaaaaaccattttttgatcatttcatgagcagatttgtgtgaaagcgtgtcaccagcagcatcacgagcactcttgattagagaagcctcggccagcctacgctggag

SEQ ID NO: 1875 - DNA, 200 bp, Conyza canadensis
cataatactcttacacccctaccttctttctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaagtagtaacgtaataaacata

SEQ ID NO: 1876 - DNA, 200 bp, Conyza canadensis
tatgtttattacgttactacttttaatacgagcatagtgtccgcgcgttgcaacggctaaaaggcgatgacaatataaaagggaggcggtggtggagatcgagggcggtggtggagaaggagggcggcggcggagggtgatagaaggtcgaggagagcgtgtaatgattagaaagaaggtaggggtgtaagagtattatg

SEQ ID NO: 1877 - DNA, 200 bp, Conyza canadensis
taaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttttggtatcgatcgttgtgtag

SEQ ID NO: 1878 - DNA, 200 bp, Conyza canadensis
ctacacaacgatcgataccaaaaagattaagaatttgactaccatagacaaatagtttagttcagtttggacccgttcgacttacactctagagtgaatgattttagcttaaatatatattcatcagtacaaaatcataacaaaataatgaaatatataaactttacgtaaactttatgtttattacgttactactttta

SEQ ID NO: 1879 - DNA, 200 bp, Conyza canadensis
ctttttggtatcgatcgttgtgtagtgttgcacacctcacttgatattagttttatgtgattatatatggttaatttaatttttctttgatttttgatcatggtcttaaatatcattaaaggtgaagaaacatgtgaagagggataaatttggagaaagaatggcatcactaaaacagatagtgtcaccctatggcaagg

SEQ ID NO: 1880 - DNA, 200 bp, Conyza canadensis
ccttgccatagggtgacactatctgttttagtgatgccattctttctccaaatttatccctcttcacatgtttcttcacctttaatgatatttaagaccatgatcaaaaatcaaagaaaaattaaattaaccatatataatcacataaaactaatatcaagtgaggtgtgcaacactacacaacgatcgataccaaaaag

SEQ ID NO: 1881 - DNA, 200 bp, Conyza canadensis
cagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtatacatacattatatatatataaag

SEQ ID NO: 1882 - DNA, 200 bp, Conyza canadensis
ctttatatatatataatgtatgtataccattctattgtgttgtaactataacccttacaactatgtttagcaaaatcctacttgtatagattggaaatcaaaacaactagtatacatatatgatatacctaatcaaacaaattacatataattaataaacttaaagaaggactaaccttgccatagggtgacactatctg

SEQ ID NO: 1883 - DNA, 200 bp, Conyza canadensis
atacatacattatatatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcgtacaggagtctagacttggaccattgtgttttagag

SEQ ID NO: 1884 - DNA, 200 bp, Conyza canadensis
ctctaaaacacaatggtccaagtctagactcctgtacgatcaacattaacacaccgtctaagcaaccatatacttacatcgactatgctattcatagcctttaaggatatggataaagcaaagtaaattggtttacatgacggttaaagattattattaataaacagttatatatctttatatatatataatgtatgtat

SEQ ID NO: 1885 - DNA, 200 bp, Conyza canadensis
agacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatttatatattgaattgtaggat

SEQ ID NO: 1886 - DNA, 200 bp, Conyza canadensis
atcctacaattcaatatataaatcttcatacacacatgtcactcatctctataggtatgagtaatcaagcctatttcgatgtatgtaacagaaattgttggttaaatttgaatgatattataactatgctcttaaaaataaaggaagttttacctttgcgttcgattcccttcttctctaaaacacaatggtccaagtct

SEQ ID NO: 1887 - DNA, 200 bp, Conyza canadensis
agatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagagagaaattagaacgtagataaa

SEQ ID NO: 1888 - DNA, 200 bp, Conyza canadensis
tttatctacgttctaatttctctctaccaatgatgtagtgtttggtaaaattaactattttatatcatctgaattccaccaagaagatgtccaactgtaattttgtaatggacatacaacaaagaaaaaaaccgcaaaccataattaactagtacattagaaatgggaaaatgatatcctacaattcaatatataaatct

SEQ ID NO: 1889 - DNA, 200 bp, Conyza canadensis
agagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaaaaaaagccaccaatacatta

SEQ ID NO: 1890 - DNA, 200 bp, Conyza canadensis
taatgtattggtggcttttttttattcaagatgtttgtactgttttattagtggttcatggttggattaacaaataatagaacattgtgtcaaatctgttgtaattggaaatctgcgaattgcaaaagacaacattttatgtaatacgagtatctcttttgaaacttacaaaccatttatctacgttctaatttctctct

SEQ ID NO: 1891 - DNA, 200 bp, Conyza canadensis
ataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgtaaaagaaacatatggatgtag

SEQ ID NO: 1892 - DNA, 200 bp, Conyza canadensis
ctacatccatatgtttcttttacgtgtatgcttttaatttgaaaagctatgattggaaagaagagagaaagttggatgtgcatttttgaacctttttaagctagaataagaataaaatacatgttttttgatattactggtcattatatggagacaaaaagcatacaacaatcaataatgtattggtggcttttttttat

SEQ ID NO: 1893 - DNA, 200 bp, Conyza canadensis
acgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaactatacatcacttaattgcac

SEQ ID NO: 1894 - DNA, 200 bp, Conyza canadensis
gtgcaattaagtgatgtatagttgggagtttggtttgtttggttggtttttggtgaggtgccataaagttacttaaatatgtagtaggtacaaaaaacaaattggggtccaaggatgggaggtgatgcagagcacgtgacatggttaaccaactaccccccacacacatatcaatctacatccatatgtttcttttacgt

SEQ ID NO: 1895 - DNA, 200 bp, Conyza canadensis
ccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgttgttccacttgtttatggtta

SEQ ID NO: 1896 - DNA, 200 bp, Conyza canadensis
taaccataaacaagtggaacaacagctgaatcaaatcaagaatttgcttctttttttagctggtttgaaaagagacagacattgacaacaacaacaaaattgtgattaaaaacaagaaaattggaatgacagaaatctgggagagatgtaagtacttgttgaggtatatgtgtgtgtgcaattaagtgatgtatagttgg

SEQ ID NO: 1897 - DNA, 200 bp, Conyza canadensis
ctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgtaatttctttgaaatttataa

SEQ ID NO: 1898 - DNA, 200 bp, Conyza canadensis
ttataaatttcaaagaaattacataaacccagtaaaaagattcaatctttacatacccaactctacttttttgctaaactcaacaaaactgataaaaacccggttcaaaaaacacaggaatttgaagaaattaactcaaagatttaaacttggggggtgaaagaatgagaaagactaaccataaacaagtggaacaacag

SEQ ID NO: 1899 - DNA, 200 bp, Conyza canadensis
tatgtaatttctttgaaatttataagtttcttgcaatgggtatatgattttctattgattgaagtggttaataacaggatttggtgagtaaagtttgaatctttcgagttatggatttatgtcataccttttcttgcccttcaaaataaagtcaaagctttagttttgtgatttgactttggtatcccttcaaaataaag

SEQ ID NO: 1900 - DNA, 200 bp, Conyza canadensis
ctttattttgaagggataccaaagtcaaatcacaaaactaaagctttgactttattttgaagggcaagaaaaggtatgacataaatccataactcgaaagattcaaactttactcaccaaatcctgttattaaccacttcaatcaatagaaaatcatatacccattgcaagaaacttataaatttcaaagaaattacata

SEQ ID NO: 1901 - DNA, 200 bp, Conyza canadensis
actttggtatcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatttgatgagttcaataataata

SEQ ID NO: 1902 - DNA, 200 bp, Conyza canadensis
tattattattgaactcatcaaattgaagtaatcactaatcacattaaaactttatcaggaaacaaatataacaaaattgaatttatcaaaatatatattacaatttacaaacagcatgaaaatattcatgggagcaacagcataccaaagtcaaatcacaaaactaaagctttgactttattttgaagggataccaaagt

SEQ ID NO: 1903 - DNA, 200 bp, Conyza canadensis
caatttgatgagttcaataataataagaaatttagaactttgaacctcgtagttctaattcgaggtttcctagctctatgtaaaccccactatattctccattataacatacgtttatgtgttactttatttagacattttaatattgactcaattataacataggttcagctgaaaatttaatttctttgttagtgaat

SEQ ID NO: 1904 - DNA, 200 bp, Conyza canadensis
attcactaacaaagaaattaaattttcagctgaacctatgttataattgagtcaatattaaaatgtctaaataaagtaacacataaacgtatgttataatggagaatatagtggggtttacatagagctaggaaacctcgaattagaactacgaggttcaaagttctaaatttcttattattattgaactcatcaaattg

SEQ ID NO: 1905 - DNA, 200 bp, Conyza canadensis
aaatttaatttctttgttagtgaattgttgtgacttttttttttggtagtttgcgttgtgatagtcaggagacagaaagggcaatttgtttctgttctttttaagttagataggtgaccatttcggtagatactagatagtgcaaagatatagtgttttttgtaagtaccaagtactttatgaacttacccaatgataac

SEQ ID NO: 1906 - DNA, 200 bp, Conyza canadensis
gttatcattgggtaagttcataaagtacttggtacttacaaaaaacactatatctttgcactatctagtatctaccgaaatggtcacctatctaacttaaaaagaacagaaacaaattgccctttctgtctcctgactatcacaacgcaaactaccaaaaaaaaaagtcacaacaattcactaacaaagaaattaaattt

SEQ ID NO: 1907 - DNA, 200 bp, Conyza canadensis
ctttatgaacttacccaatgataacaacttttgatggttcagtggttcagccttctctttgtccctagactaattagtccaatctatctctcagtatatattttttaggtattgacatattttatgatattggcaagttggtagtttactttcaacttttaagcaatatatggacatatccacatatatcagttccatat

SEQ ID NO: 1908 - DNA, 200 bp, Conyza canadensis
atatggaactgatatatgtggatatgtccatatattgcttaaaagttgaaagtaaactaccaacttgccaatatcataaaatatgtcaatacctaaaaaatatatactgagagatagattggactaattagtctagggacaaagagaaggctgaaccactgaaccatcaaaagttgttatcattgggtaagttcataaag

SEQ ID NO: 1909 - DNA, 200 bp, Conyza canadensis
atatccacatatatcagttccatattactagcatgtatcctattctgggttagtatgctacaaaaagggtttacatgtcaaatgcagaattgttcaaagaaaacgagttgttagacctaataagtcaaagtaatgcttactctacactttgcttactgtttggcagtggcaccatgtcagaagctcaaagaatgcttcta

SEQ ID NO: 1910 - DNA, 200 bp, Conyza canadensis
tagaagcattctttgagcttctgacatggtgccactgccaaacagtaagcaaagtgtagagtaagcattactttgacttattaggtctaacaactcgttttctttgaacaattctgcatttgacatgtaaaccctttttgtagcatactaacccagaataggatacatgctagtaatatggaactgatatatgtggatat

SEQ ID NO: 1911 - DNA, 200 bp, Conyza canadensis
gtcagaagctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaagtattttaattgcaaataatggaatggcggctgtaaagtttataagaagtg

SEQ ID NO: 1912 - DNA, 200 bp, Conyza canadensis
cacttcttataaactttacagccgccattccattatttgcaattaaaatactttggattggcctggtgcctccaagtgcattacaaaattcatcaattgcagatctactagcagaagacctcagtgaaatcgccccatttacaatgccattaccataataattgaaacttccacttagaagcattctttgagcttctgac

SEQ ID NO: 1913 - DNA, 200 bp, Conyza canadensis
gcggctgtaaagtttataagaagtgtgaggacatggagttatgaaacatttggctcagataaagctattttgctggtagccatggctacaccggaagatatgaggataaatgccgagcatattagaatcgctgatcagtttgttgaagtccctggtggtacaaataataataattatgcgaatgtgcaactcattgtaga

SEQ ID NO: 1914 - DNA, 200 bp, Conyza canadensis
tctacaatgagttgcacattcgcataattattattatttgtaccaccagggacttcaacaaactgatcagcgattctaatatgctcggcatttatcctcatatcttccggtgtagccatggctaccagcaaaatagctttatctgagccaaatgtttcataactccatgtcctcacacttcttataaactttacagccgc

SEQ ID NO: 1915 - DNA, 200 bp, Conyza canadensis
atgcgaatgtgcaactcattgtagaggtatgtagcttatatacgtggatcctacatcatgatttataagctttaaaatgatctattttatgaaacattgtgcatttaatgatgcctgaaaagattatgtttccaagacttattttgcttaacttgttggatcaaaatgttgatctgcttccatgaatatagtaattcgaa

SEQ ID NO: 1916 - DNA, 200 bp, Conyza canadensis
ttcgaattactatattcatggaagcagatcaacattttgatccaacaagttaagcaaaataagtcttggaaacataatcttttcaggcatcattaaatgcacaatgtttcataaaatagatcattttaaagcttataaatcatgatgtaggatccacgtatataagctacatacctctacaatgagttgcacattcgcat

SEQ ID NO: 1917 - DNA, 200 bp, Conyza canadensis
gcttccatgaatatagtaattcgaatatgttggtttaatcttcactttcaaaaaaaaaaaaaaatactttcaactttttatgttagcattgagtttgaatctcaagagaacttatttcacttttgaaatcgatatggatgtgttgaacatgtaattgataatcagcaacattttaaaatttattagaaaatgacgaggga

SEQ ID NO: 1918 - DNA, 200 bp, Conyza canadensis
tccctcgtcattttctaataaattttaaaatgttgctgattatcaattacatgttcaacacatccatatcgatttcaaaagtgaaataagttctcttgagattcaaactcaatgctaacataaaaagttgaaagtatttttttttttttttgaaagtgaagattaaaccaacatattcgaattactatattcatggaagc

SEQ ID NO: 1919 - DNA, 200 bp, Conyza canadensis
aaatttattagaaaatgacgagggatgcctcttcaggctacgcggcgagcctttggctctaatgtaagcggcctaaccggtatacccgggtctcttctgagatctttgggtcaccttaccactagacccccttggagaaggttttaaaaagtattagaaagtatataaatataaaatagaaacgatatgtaaaatttaaa

SEQ ID NO: 1920 - DNA, 200 bp, Conyza canadensis
tttaaattttacatatcgtttctattttatatttatatactttctaatactttttaaaaccttctccaagggggtctagtggtaaggtgacccaaagatctcagaagagacccgggtataccggttaggccgcttacattagagccaaaggctcgccgcgtagcctgaagaggcatccctcgtcattttctaataaattt

SEQ ID NO: 1921 - DNA, 200 bp, Conyza canadensis
atagaaacgatatgtaaaatttaaaaaatatgtttcattgagttatcttacacctgactatttgatattgagcattaatacgagtttgatggaaaatataaaataattaatatttagctatcatcatcaattcctttaaaatggttcatttatgatttatgacttcagactgctgagataacacatgttgatgctgtttg

SEQ ID NO: 1922 - DNA, 200 bp, Conyza canadensis
caaacagcatcaacatgtgttatctcagcagtctgaagtcataaatcataaatgaaccattttaaaggaattgatgatgatagctaaatattaattattttatattttccatcaaactcgtattaatgctcaatatcaaatagtcaggtgtaagataactcaatgaaacatattttttaaattttacatatcgtttctat

SEQ ID NO: 1923 - DNA, 200 bp, Conyza canadensis
agataacacatgttgatgctgtttggcctggttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcat

SEQ ID NO: 1924 - DNA, 200 bp, Conyza canadensis
atgagaaccgctccaaggaagtgtcggtacatcagcagcttgtgcaatcaaagaagaaccaattttatcacctaaagctgccatggaggaagctggtggcccaagaaatacaataccttttgcttccaatgcatcaggcagctcagggatttcggatgcatggccccaaccaggccaaacagcatcaacatgtgttatct

SEQ ID NO: 1925 - DNA, 200 bp, Conyza canadensis
gacacttccttggagcggttctcatgtaagattttttttactattgtagtctttgtcacatcaacaatgatccttatacttttaactccataaagattgcatcgttctatctcatattctctataatctaaaaaaattctatattcctcttatttgtgaaaagtctgaacttcataacaaaatcacatcttgtacctctt

SEQ ID NO: 1926 - DNA, 200 bp, Conyza canadensis
aagaggtacaagatgtgattttgttatgaagttcagacttttcacaaataagaggaatatagaatttttttagattatagagaatatgagatagaacgatgcaatctttatggagttaaaagtataaggatcattgttgatgtgacaaagactacaatagtaaaaaaaatcttacatgagaaccgctccaaggaagtgtc

SEQ ID NO: 1927 - DNA, 200 bp, Conyza canadensis
aacaaaatcacatcttgtacctcttatatattaaactgcatctttatgcctctaatttattggaaacaagatctttaaatcctttaaaggttgcatctttatacctcttattctgtagaaattacatttcataccacttgttctttgcaatttcgcatagatattaatgcctactctttaaaagatacattttctacttc

SEQ ID NO: 1928 - DNA, 200 bp, Conyza canadensis
gaagtagaaaatgtatcttttaaagagtaggcattaatatctatgcgaaattgcaaagaacaagtggtatgaaatgtaatttctacagaataagaggtataaagatgcaacctttaaaggatttaaagatcttgtttccaataaattagaggcataaagatgcagtttaatatataagaggtacaagatgtgattttgtt

SEQ ID NO: 1929 - DNA, 200 bp, Conyza canadensis
ctttaaaagatacattttctacttctttacctctataatcacatctttgtacctttcacctctccagtcttcttactctctacagtcacatttttaggtaaaaattcctgtggatagctgtttggacacactcccggatgatgtatatagaaaagcgtgtgtgcatacaacagaagaagcaattgctagttgtcaagttg

SEQ ID NO: 1930 - DNA, 200 bp, Conyza canadensis
caacttgacaactagcaattgcttcttctgttgtatgcacacacgcttttctatatacatcatccgggagtgtgtccaaacagctatccacaggaatttttacctaaaaatgtgactgtagagagtaagaagactggagaggtgaaaggtacaaagatgtgattatagaggtaaagaagtagaaaatgtatcttttaaag

SEQ ID NO: 1931 - DNA, 200 bp, Conyza canadensis
gaagcaattgctagttgtcaagttgttggttatccagcaatgattaaggcatcatggggtggaggtggcaaaggcataagaaaggtttgattctttacaattgggaaattatttcttctcctcaaagtatacggcaaacttttaaaaccaattacctattgaaactttaggtgcataatgacgaagaagtcaaggcactt

SEQ ID NO: 1932 - DNA, 200 bp, Conyza canadensis
aagtgccttgacttcttcgtcattatgcacctaaagtttcaataggtaattggttttaaaagtttgccgtatactttgaggagaagaaataatttcccaattgtaaagaatcaaacctttcttatgcctttgccacctccaccccatgatgccttaatcattgctggataaccaacaacttgacaactagcaattgcttc

SEQ ID NO: 1933 - DNA, 200 bp, Conyza canadensis
taatgacgaagaagtcaaggcactttttaagcaagttcagggtgaagtgcctggttcccctattttcattatgaaagttgcttctcaggtaggacaatgttgtaattgttattattttcccaatttcaactcaaaacccattatcattataataatatgttgatttcttgtatatacagagccgacatctagaagtgcag

SEQ ID NO: 1934 - DNA, 200 bp, Conyza canadensis
ctgcacttctagatgtcggctctgtatatacaagaaatcaacatattattataatgataatgggttttgagttgaaattgggaaaataataacaattacaacattgtcctacctgagaagcaactttcataatgaaaataggggaaccaggcacttcaccctgaacttgcttaaaaagtgccttgacttcttcgtcatta

SEQ ID NO: 1935 - DNA, 200 bp, Conyza canadensis
acagagccgacatctagaagtgcagctactatgcgatcaacatgggaatgtagcagctttgcatagtcgtgattgcagtgttcaaaggcgacatcaaaaggtaagttcatgtttgtcctttttactttctttttatcctgttttgtaactctaattttatttaatacttgatatgtcaagattattgaagaggggccaat

SEQ ID NO: 1936 - DNA, 200 bp, Conyza canadensis
attggcccctcttcaataatcttgacatatcaagtattaaataaaattagagttacaaaacaggataaaaagaaagtaaaaaggacaaacatgaacttaccttttgatgtcgcctttgaacactgcaatcacgactatgcaaagctgctacattcccatgttgatcgcatagtagctgcacttctagatgtcggctctgt

SEQ ID NO: 1937 - DNA, 200 bp, Conyza canadensis
tcaagattattgaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggtgcttgcaatttctgttttg

SEQ ID NO: 1938 - DNA, 200 bp, Conyza canadensis
caaaacagaaattgcaagcacctgtaaccggggattgagctccaaaaagtaatagtctccagtttccatgctatacaaatactctacagtggctgctccaacataattaaccgactttgctaatcttctcgccgcttgctcaagcttctttattgtgtcatgtggagctatggttattggcccctcttcaataatcttga

SEQ ID NO: 1939 - DNA, 200 bp, Conyza canadensis
acaggtgcttgcaatttctgttttgtgggtcctagttatgtgtcctaagaagtaagatgaaatggtgggctccaagatggttatgatttgttttctgaagctatgtatgtggaacctttctttaggttgagcatccagtcacagagtggatagcggaaatcaatctacctgcagcacaagttgcggttggaatgggcatt

SEQ ID NO: 1940 - DNA, 200 bp, Conyza canadensis
aatgcccattccaaccgcaacttgtgctgcaggtagattgatttccgctatccactctgtgactggatgctcaacctaaagaaaggttccacatacatagcttcagaaaacaaatcataaccatcttggagcccaccatttcatcttacttcttaggacacataactaggacccacaaaacagaaattgcaagcacctgt

SEQ ID NO: 1941 - DNA, 200 bp, Conyza canadensis
acaagttgcggttggaatgggcattcctctttggcaaataccaggttagatatcaaaagttcgttttttgttgactatcatagttggtcttttgctacaatgcaaccatcatgtcaactattttcttaatttctctacatgtcttgttggcttagaaataagacgattttatggaatggacaatagtggaggatacgatg

SEQ ID NO: 1942 - DNA, 200 bp, Conyza canadensis
catcgtatcctccactattgtccattccataaaatcgtcttatttctaagccaacaagacatgtagagaaattaagaaaatagttgacatgatggttgcattgtagcaaaagaccaactatgatagtcaacaaaaaacgaacttttgatatctaacctggtatttgccaaagaggaatgcccattccaaccgcaacttgt

SEQ ID NO: 1943 - DNA, 200 bp, Conyza canadensis
atggacaatagtggaggatacgatgcttggaggagaacatctgctcttgcaactccatttgactttgacaaggcagagtctatcagcccaaaaggtcattgtattgctgtacgtgtaacaagtgaggacccagatgatggatttaagcccactagtggaaaagttcaggtttggaagcagactaacatataccatatacc

SEQ ID NO: 1944 - DNA, 200 bp, Conyza canadensis
ggtatatggtatatgttagtctgcttccaaacctgaacttttccactagtgggcttaaatccatcatctgggtcctcacttgttacacgtacagcaatacaatgaccttttgggctgatagactctgccttgtcaaagtcaaatggagttgcaagagcagatgttctcctccaagcatcgtatcctccactattgtccat

SEQ ID NO: 1945 - DNA, 200 bp, Conyza canadensis
agcagactaacatataccatatacccctacaaatataatatatatccttttttttttttttttaccatattgatcgaattccacttttaggagctaagttttaaaagcaagccaaatgtctgggcatacttttctgtcaaggtacgctgggttcaaacctttttttttttttttgaacttccaattgacatattctaaaa

SEQ ID NO: 1946 - DNA, 200 bp, Conyza canadensis
ttttagaatatgtcaattggaagttcaaaaaaaaaaaaaaaggtttgaacccagcgtaccttgacagaaaagtatgcccagacatttggcttgcttttaaaacttagctcctaaaagtggaattcgatcaatatggtaaaaaaaaaaaaaaaaggatatatattatatttgtaggggtatatggtatatgttagtctgct

SEQ ID NO: 1947 - DNA, 200 bp, Conyza canadensis
aacttccaattgacatattctaaaatgtttgaacattgcagtccggaggaggcattcatgaattctcagattctcaatttggtaaagacgactggatcttgtttggttgaaatatcttgaatactcacttattggtgtagttcaagtttacattcttggtcaaaacgttcatgttctcattttaattctgtatctatctt

SEQ ID NO: 1948 - DNA, 200 bp, Conyza canadensis
aagatagatacagaattaaaatgagaacatgaacgttttgaccaagaatgtaaacttgaactacaccaataagtgagtattcaagatatttcaaccaaacaagatccagtcgtctttaccaaattgagaatctgagaattcatgaatgcctcctccggactgcaatgttcaaacattttagaatatgtcaattggaagtt

SEQ ID NO: 1949 - DNA, 200 bp, Conyza canadensis
ctcattttaattctgtatctatcttaggccacgtttttgcatttggcgagtcaagacctttggctattgcaaatatggttcttgggctgaaggaaattcaaattcgtggcgagatccgtacgaatgttgattatacaattgatctgttacatgtgagcattttggggtttcacagctaacaaatttcttattttgtttac

SEQ ID NO: 1950 - DNA, 200 bp, Conyza canadensis
gtaaacaaaataagaaatttgttagctgtgaaaccccaaaatgctcacatgtaacagatcaattgtataatcaacattcgtacggatctcgccacgaatttgaatttccttcagcccaagaaccatatttgcaatagccaaaggtcttgactcgccaaatgcaaaaacgtggcctaagatagatacagaattaaaatgag

SEQ ID NO: 1951 - DNA, 200 bp, Conyza canadensis
ctaacaaatttcttattttgtttaccataatgagttacttcatggcgatataaggggtgagccatggagcaagtgccatgtatcttaacagataaattgttatgttcatgtttggcgagtacttacacatttgagaatgtcgagaatttgattatatttcaccaaacgttcttattgcttcacctaaaatgtgaacgttt

SEQ ID NO: 1952 - DNA, 200 bp, Conyza canadensis
aaacgttcacattttaggtgaagcaataagaacgtttggtgaaatataatcaaattctcgacattctcaaatgtgtaagtactcgccaaacatgaacataacaatttatctgttaagatacatggcacttgctccatggctcaccccttatatcgccatgaagtaactcattatggtaaacaaaataagaaatttgttag

SEQ ID NO: 1953 - DNA, 200 bp, Conyza canadensis
tgcttcacctaaaatgtgaacgttttcttacatgcttagtttttattcctttttctatacttgtaggctcctgattatagagaaaataaaatacataccggttggttagatagccgaattgctatgagggttagagcagaaaggcccccttggtatctttcagtagttgggggagcactttacgtaagtacaaaatacct

SEQ ID NO: 1954 - DNA, 200 bp, Conyza canadensis
aggtattttgtacttacgtaaagtgctcccccaactactgaaagataccaagggggcctttctgctctaaccctcatagcaattcggctatctaaccaaccggtatgtattttattttctctataatcaggagcctacaagtatagaaaaaggaataaaaactaagcatgtaagaaaacgttcacattttaggtgaagca

SEQ ID NO: 1955 - DNA, 200 bp, Conyza canadensis
cactttacgtaagtacaaaatacctctttctttctatattcgtcatttttaaagtacttttacttaccattgatgtttgttaacttcagaaagctgctgctagaagtgcagccatggtctcggactatgttggttaccttgaaaagggccaaatccctcctaaggtttgtcagatattttagtatttttttttaattttt

SEQ ID NO: 1956 - DNA, 200 bp, Conyza canadensis
aaaaattaaaaaaaaatactaaaatatctgacaaaccttaggagggatttggcccttttcaaggtaaccaacatagtccgagaccatggctgcacttctagcagcagctttctgaagttaacaaacatcaatggtaagtaaaagtactttaaaaatgacgaatatagaaagaaagaggtattttgtacttacgtaaagtg

SEQ ID NO: 1957 - DNA, 200 bp, Conyza canadensis
attttagtatttttttttaatttttaagagttggttctcgtaatgtttacattgatgatcagtatttgtctgttttcttactttcagcatatatcattggtcaactcacaagtttctttgaatattgagggcagcaaatacacggtaaataacaagataactgcctatcgttattcgttcataaaaatggttgttcttga

SEQ ID NO: 1958 - DNA, 200 bp, Conyza canadensis
tcaagaacaaccatttttatgaacgaataacgataggcagttatcttgttatttaccgtgtatttgctgccctcaatattcaaagaaacttgtgagttgaccaatgatatatgctgaaagtaagaaaacagacaaatactgatcatcaatgtaaacattacgagaaccaactcttaaaaattaaaaaaaaatactaaaat

SEQ ID NO: 1959 - DNA, 200 bp, Conyza canadensis
cgttcataaaaatggttgttcttgaagttttcttttgtgtgttttttttcttctgatttttttctttttatttgttagattgatatggtaaaaagagggccaggaagttacagattgagaatgaatcaatccgagattgaagcagagatacatacactacgtgacggaggcttattgatgcaggtacttaatccatacgc

SEQ ID NO: 1960 - DNA, 200 bp, Conyza canadensis
gcgtatggattaagtacctgcatcaataagcctccgtcacgtagtgtatgtatctctgcttcaatctcggattgattcattctcaatctgtaacttcctggccctctttttaccatatcaatctaacaaataaaaagaaaaaaatcagaagaaaaaaaacacacaaaagaaaacttcaagaacaaccatttttatgaacg

SEQ ID NO: 1961 - DNA, 200 bp, Conyza canadensis
tgatgcaggtacttaatccatacgctctatttttctttctatttggtttattctgtcaaattttctttttatttggtttattctgtcaaaatttctttttatttggtttattccgtagttagtttgtgattaactgattactatattaagtcattggttggtatgtatacatataaaactcgaatataagcattttaatg

SEQ ID NO: 1962 - DNA, 200 bp, Conyza canadensis
cattaaaatgcttatattcgagttttatatgtatacataccaaccaatgacttaatatagtaatcagttaatcacaaactaactacggaataaaccaaataaaaagaaattttgacagaataaaccaaataaaaagaaaatttgacagaataaaccaaatagaaagaaaaatagagcgtatggattaagtacctgcatca

SEQ ID NO: 1963 - DNA, 200 bp, Conyza canadensis
aaactcgaatataagcattttaatgatgccaaacctatatgtagttttactctttaggatttcatgatatacctaggaaatccctcgtgtctttgtggcagctagcaagttgaagattaataatatcaataaagaaattcagagaatttaatgcagcatgttctaagggagtgttcggggatgcattctgaaaataatta

SEQ ID NO: 1964 - DNA, 200 bp, Conyza canadensis
taattattttcagaatgcatccccgaacactcccttagaacatgctgcattaaattctctgaatttctttattgatattattaatcttcaacttgctagctgccacaaagacacgagggatttcctaggtatatcatgaaatcctaaagagtaaaactacatataggtttggcatcattaaaatgcttatattcgagttt

SEQ ID NO: 1965 - DNA, 200 bp, Conyza canadensis
cggggatgcattctgaaaataattatgtgatatttagtaaaattgcaattaaacgtggtgcaagaaatagtgtttggatatgcttctgctataaagttctggcaatcgctgtattgagtgtttgacggattatgtctatttaagaaggtggtagataaactaaaagtatacatggttagtggtgctgtaagcatttgcca

SEQ ID NO: 1966 - DNA, 200 bp, Conyza canadensis
tggcaaatgcttacagcaccactaaccatgtatacttttagtttatctaccaccttcttaaatagacataatccgtcaaacactcaatacagcgattgccagaactttatagcagaagcatatccaaacactatttcttgcaccacgtttaattgcaattttactaaatatcacataattattttcagaatgcatccccg

SEQ ID NO: 1967 - DNA, 200 bp, Conyza canadensis
ttagtggtgctgtaagcatttgccatcaaaaagtaggtagataaaggaagagtgctataggtagttttatgctactttttggttatcgagttcgttgcagctagtatcaaactaattctttaactatcgtagctgtaataggtcaccctgaacatttcaatttattgcaaccttaagttacatcatttgataatcacgtt

SEQ ID NO: 1968 - DNA, 200 bp, Conyza canadensis
aacgtgattatcaaatgatgtaacttaaggttgcaataaattgaaatgttcagggtgacctattacagctacgatagttaaagaattagtttgatactagctgcaacgaactcgataaccaaaaagtagcataaaactacctatagcactcttcctttatctacctactttttgatggcaaatgcttacagcaccactaa

SEQ ID NO: 1969 - DNA, 200 bp, Conyza canadensis
agttacatcatttgataatcacgttcaagacacattcttattttatactctgatatcatatgatttgtggttggttgattcaatgatgtagttggatgggaatagtcatatattatacgccgaggaagaagctgccggtactcgcttgcttattgatggacggacttgcttgcttcaggtgcgaacaactagttcttttc

SEQ ID NO: 1970 - DNA, 200 bp, Conyza canadensis
gaaaagaactagttgttcgcacctgaagcaagcaagtccgtccatcaataagcaagcgagtaccggcagcttcttcctcggcgtataatatatgactattcccatccaactacatcattgaatcaaccaaccacaaatcatatgatatcagagtataaaataagaatgtgtcttgaacgtgattatcaaatgatgtaact

SEQ ID NO: 1971 - DNA, 200 bp, Conyza canadensis
caggtgcgaacaactagttcttttcttgaactttatttagaggttgccatttcaaccatttatctatgatgggacaatttaaacaatgttttacccttaatggtgtattcaaatgggtcaacagtgacccaaagtacattctcactggagcaaactgcctgtatcatttttttttgtgaggttcattgtttttgaataat

SEQ ID NO: 1972 - DNA, 200 bp, Conyza canadensis
attattcaaaaacaatgaacctcacaaaaaaaaatgatacaggcagtttgctccagtgagaatgtactttgggtcactgttgacccatttgaatacaccattaagggtaaaacattgtttaaattgtcccatcatagataaatggttgaaatggcaacctctaaataaagttcaagaaaagaactagttgttcgcacctg

SEQ ID NO: 1973 - DNA, 200 bp, Conyza canadensis
gtgaggttcattgtttttgaataatattgtgttaattttcatatttagtagactaaagtaattatgtaagttgttgtgaacccgttcgatctgctcaggttatactcaaccggttgcaatcctcctaatttgccacctttactattacttactatttgggttacctgtttatagaatgatcatgatccttccaagttgat

SEQ ID NO: 1974 - DNA, 200 bp, Conyza canadensis
atcaacttggaaggatcatgatcattctataaacaggtaacccaaatagtaagtaatagtaaaggtggcaaattaggaggattgcaaccggttgagtataacctgagcagatcgaacgggttcacaacaacttacataattactttagtctactaaatatgaaaattaacacaatattattcaaaaacaatgaacctcac

SEQ ID NO: 1975 - DNA, 200 bp, Conyza canadensis
atgatcatgatccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggttagcatg

SEQ ID NO: 1976 - DNA, 200 bp, Conyza canadensis
catgctaacctgcatggcttgaccttctgacatcttgaattgtataactccagcagccggtgaaaggagtggcatacacatcttcataacttcaacctcagcatacggtgtgtcagcattaacatggctatcatctgagaccaagtaccttagaagtttgcatggtgtttcagccatcaacttggaaggatcatgatcat

SEQ ID NO: 1977 - DNA, 200 bp, Conyza canadensis
aggtcaagccatgcaggttagcatgtcactttttccccatttttaagaagtatttacattgttcagtttttccgaacatccaagaataaagctcttggttctatgtttttgccaactacttacagctatttatatttacatgttaataaaatgttctatcgattgacttcttgagtcattgtgcttatcgcaactcaatc

SEQ ID NO: 1978 - DNA, 200 bp, Conyza canadensis
gattgagttgcgataagcacaatgactcaagaagtcaatcgatagaacattttattaacatgtaaatataaatagctgtaagtagttggcaaaaacatagaaccaagagctttattcttggatgttcggaaaaactgaacaatgtaaatacttcttaaaaatggggaaaaagtgacatgctaacctgcatggcttgacct

SEQ ID NO: 1979 - DNA, 200 bp, Conyza canadensis
tcattgtgcttatcgcaactcaatcttcgttattgtacagtgattttttaaatgtaatactgccaactttttgaataaatcgtatcaaatgtaatctttaagctatataacaaacatatgaatttcgatttccaaataatatctacagttcacaaacaaatgcttgtttcctgcttgttaataccatttttgtcttctct

SEQ ID NO: 1980 - DNA, 200 bp, Conyza canadensis
agagaagacaaaaatggtattaacaagcaggaaacaagcatttgtttgtgaactgtagatattatttggaaatcgaaattcatatgtttgttatatagcttaaagattacatttgatacgatttattcaaaaagttggcagtattacatttaaaaaatcactgtacaataacgaagattgagttgcgataagcacaatga

SEQ ID NO: 1981 - DNA, 200 bp, Conyza canadensis
tgttaataccatttttgtcttctctaaatcatacataccaaaaccaaaattgttgatcatttctgatgaatataaatctttgtatatgtaggctggtgagcttatagcaaggctagatcttgacgatccgtcagctgtaagaaaagcagagcctttcaatggaaactttcctcttcttgggcctccaacggccatgtcag

SEQ ID NO: 1982 - DNA, 200 bp, Conyza canadensis
ctgacatggccgttggaggcccaagaagaggaaagtttccattgaaaggctctgcttttcttacagctgacggatcgtcaagatctagccttgctataagctcaccagcctacatatacaaagatttatattcatcagaaatgatcaacaattttggttttggtatgtatgatttagagaagacaaaaatggtattaaca

SEQ ID NO: 1983 - DNA, 200 bp, Conyza canadensis
cttgggcctccaacggccatgtcagacaaagtgcatcagaagtgtgctgcaactttaaatgctgctcgaatgattctcgcaggctatgatcataacattgatgaagtaacttgtttgccatttactgatttcaaattttctgaaagattattctgttaacagttctgatctttgatcgtaggttgtgcaaaacttgcttc

SEQ ID NO: 1984 - DNA, 200 bp, Conyza canadensis
gaagcaagttttgcacaacctacgatcaaagatcagaactgttaacagaataatctttcagaaaatttgaaatcagtaaatggcaaacaagttacttcatcaatgttatgatcatagcctgcgagaatcattcgagcagcatttaaagttgcagcacacttctgatgcactttgtctgacatggccgttggaggcccaag

SEQ ID NO: 1985 - DNA, 200 bp, Conyza canadensis
tcgtaggttgtgcaaaacttgcttcgttgtcttgatagtcccgagcttcctttccttcagtggcaagaatgctttgcagttctagcaaatcgtctccctaaagatctaagaaacaaggcaaattgatattttacccttttttttttcttttcaagcagttaacattgggattatttttctaaattcaatatgttttgtat

SEQ ID NO: 1986 - DNA, 200 bp, Conyza canadensis
atacaaaacatattgaatttagaaaaataatcccaatgttaactgcttgaaaagaaaaaaaaaagggtaaaatatcaatttgccttgtttcttagatctttagggagacgatttgctagaactgcaaagcattcttgccactgaaggaaaggaagctcgggactatcaagacaacgaagcaagttttgcacaacctacga

SEQ ID NO: 1987 - DNA, 200 bp, Conyza canadensis
tttctaaattcaatatgttttgtatattcagttggaatccaagtttaaggagtacgaaggaatttccacacaacaaactattgactttcctgctagagttctacgggtcattcttgaagttagttgtgatcagtagttttctttataagtcctttctttgatttaaagacataatttagttatatgttacctttgtaatg

SEQ ID NO: 1988 - DNA, 200 bp, Conyza canadensis
cattacaaaggtaacatataactaaattatgtctttaaatcaaagaaaggacttataaagaaaactactgatcacaactaacttcaagaatgacccgtagaactctagcaggaaagtcaatagtttgttgtgtggaaattccttcgtactccttaaacttggattccaactgaatatacaaaacatattgaatttagaaa

SEQ ID NO: 1989 - DNA, 200 bp, Conyza canadensis
ttagttatatgttacctttgtaatgttttcgttcagacccatcttggatcttgctcagaaaaagaaaagggagcccaagaaaggctcgttgagccattaatgggtcttgtaaagtcgtatgaagggggaagagaaagtcatgcacgtgggatcgttcatgctctatttgatgaatatttatctgttgaagagttgttcag

SEQ ID NO: 1990 - DNA, 200 bp, Conyza canadensis
ctgaacaactcttcaacagataaatattcatcaaatagagcatgaacgatcccacgtgcatgactttctcttcccccttcatacgactttacaagacccattaatggctcaacgagcctttcttgggctcccttttctttttctgagcaagatccaagatgggtctgaacgaaaacattacaaaggtaacatataactaa

SEQ ID NO: 1991 - DNA, 200 bp, Conyza canadensis
atttatctgttgaagagttgttcagcgacaacattcaggtgcgtttgttaggatcgccgatccagtattttggattttcgatagggcatgcacttgcattaccatagtcagtttatattttatttcatcttgttacacgacaacaaagtaccttttttcaaagtataaaactgcacaggttatgtgctcccaaagggttt

SEQ ID NO: 1992 - DNA, 200 bp, Conyza canadensis
aaaccctttgggagcacataacctgtgcagttttatactttgaaaaaaggtactttgttgtcgtgtaacaagatgaaataaaatataaactgactatggtaatgcaagtgcatgccctatcgaaaatccaaaatactggatcggcgatcctaacaaacgcacctgaatgttgtcgctgaacaactcttcaacagataaat

SEQ ID NO: 1993 - DNA, 200 bp, Conyza canadensis
caggttatgtgctcccaaagggttttttaatactttgatctatgtggaaatggtataagagttttaatcattttgacattaatgtctggataaatttgttacgggttaaaccaatcaatctaagccaaaccaaaagttacctgcaaaagctattacctaacccacccattttgccacctctgttggttttctttaggtct

SEQ ID NO: 1994 - DNA, 200 bp, Conyza canadensis
agacctaaagaaaaccaacagaggtggcaaaatgggtgggttaggtaatagcttttgcaggtaacttttggtttggcttagattgattggtttaacccgtaacaaatttatccagacattaatgtcaaaatgattaaaactcttataccatttccacatagatcaaagtattaaaaaaccctttgggagcacataacctg

SEQ ID NO: 1995 - DNA, 200 bp, Conyza canadensis
acctctgttggttttctttaggtctactaatggttatcgagtaaattatattataacataagtagtaaaccaaaatcctgtaccttttaggctgatgtaatcgaacgtcttcgacaactatacaagaaagatctcttgaggattgtcgacattgtcctttcccatcaggtacacatgttttttggtttttgttctcccct

SEQ ID NO: 1996 - DNA, 200 bp, Conyza canadensis
aggggagaacaaaaaccaaaaaacatgtgtacctgatgggaaaggacaatgtcgacaatcctcaagagatctttcttgtatagttgtcgaagacgttcgattacatcagcctaaaaggtacaggattttggtttactacttatgttataatataatttactcgataaccattagtagacctaaagaaaaccaacagaggt

SEQ ID NO: 1997 - DNA, 200 bp, Conyza canadensis
tgttttttggtttttgttctcccctttaatgtgtattttataccgatcattaatatatgtccatgcagggtgttaggagtaaaaacaaattgatactacggctgatggagcatttggtttaccccaatccggctgcgtatagggagaaactgatacgattttctcaacttaaccacacaagttattctgaggtcatcatc

SEQ ID NO: 1998 - DNA, 200 bp, Conyza canadensis
gatgatgacctcagaataacttgtgtggttaagttgagaaaatcgtatcagtttctccctatacgcagccggattggggtaaaccaaatgctccatcagccgtagtatcaatttgtttttactcctaacaccctgcatggacatatattaatgatcggtataaaatacacattaaaggggagaacaaaaaccaaaaaaca

SEQ ID NO: 1999 - DNA, 200 bp, Conyza canadensis
cacaagttattctgaggtcatcatcgtcatatatatacactgttacaattttgatcatctcaatcacttttctgttagtactgagtttatgttaattgattattattaatagttagcactgaaggcaagtcaacttttagaacaaactaaactaagtgaacttcgttcaagcattgcgcgaagtctttctgaattagaga

SEQ ID NO: 2000 - DNA, 200 bp, Conyza canadensis
tctctaattcagaaagacttcgcgcaatgcttgaacgaagttcacttagtttagtttgttctaaaagttgacttgccttcagtgctaactattaataataatcaattaacataaactcagtactaacagaaaagtgattgagatgatcaaaattgtaacagtgtatatatatgacgatgatgacctcagaataacttgtg

SEQ ID NO: 2001 - DNA, 200 bp, Conyza canadensis
gcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagatt

SEQ ID NO: 2002 - DNA, 200 bp, Conyza canadensis
aatcttcgaacataggtctcaacaacacgcctttgaagggtgtgatcgctatggtcaaaaagaccaacaagggcatcttcaactgccaatggagcactcacaatatcctccattctttcattaatggcactcttcctcttaggggtatccatattttcaccttcttcagtaaacatctctaattcagaaagacttcgcgc

SEQ ID NO: 2003 - DNA, 200 bp, Conyza canadensis
ttgttgagacctatgttcgaagattatatcaggtttttacctttcatttctgcatcaacagagttgtcaatttgttgtcatagaaaattaaaggtgtttgatcagattgttttaaataaaatgtggtttaatatatgcatacatctttaaaaaaagaaacgacatgtatttattggtaaaaaactaaaacatcaaatcaa

SEQ ID NO: 2004 - DNA, 200 bp, Conyza canadensis
ttgatttgatgttttagttttttaccaataaatacatgtcgtttctttttttaaagatgtatgcatatattaaaccacattttatttaaaacaatctgatcaaacacctttaattttctatgacaacaaattgacaactctgttgatgcagaaatgaaaggtaaaaacctgatataatcttcgaacataggtctcaacaa

SEQ ID NO: 2005 - DNA, 200 bp, Conyza canadensis
gtaaaaaactaaaacatcaaatcaagtgtggattttatactgttttttacaaaactttgtaaactgattatatgttgtttacttgaacagataaatgttttaaactattaagaatatttaaaagatggaataagaataaatttaaagtcatttctgagttgtggcccttgagaatagctgttcatgtagttagtagacct

SEQ ID NO: 2006 - DNA, 200 bp, Conyza canadensis
aggtctactaactacatgaacagctattctcaagggccacaactcagaaatgactttaaatttattcttattccatcttttaaatattcttaatagtttaaaacatttatctgttcaagtaaacaacatataatcagtttacaaagttttgtaaaaaacagtataaaatccacacttgatttgatgttttagttttttac

SEQ ID NO: 2007 - DNA, 200 bp, Conyza canadensis
agctgttcatgtagttagtagacctatttgacttttttctaaaatgtatactacactgtttattaatgcctactcaaatgaatcgggttgtctaaaataaaacatcacttataacaacaataaaagaagcaaagcagtcattttagtttgcacttttgcaattctcttggtaggaagaaatctaatatgattttaactga

SEQ ID NO: 2008 - DNA, 200 bp, Conyza canadensis
tcagttaaaatcatattagatttcttcctaccaagagaattgcaaaagtgcaaactaaaatgactgctttgcttcttttattgttgttataagtgatgttttattttagacaacccgattcatttgagtaggcattaataaacagtgtagtatacattttagaaaaaagtcaaataggtctactaactacatgaacagct

SEQ ID NO: 2009 - DNA, 200 bp, Conyza canadensis
agaaatctaatatgattttaactgaccatgcttctcatatctgtatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagcta

SEQ ID NO: 2010 - DNA, 200 bp, Conyza canadensis
tagctccccatttcttgtcttccaagggagcttcattctgttcatagtcaggcacattaacttctccaatgagtccttctataaattgccatgtagcgatgagtccggatctgtgccactgcattctaacactccccttcacgagatatggctgatacagatatgagaagcatggtcagttaaaatcatattagatttct

SEQ ID NO: 2011 - DNA, 200 bp, Conyza canadensis
ttggaagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaaga

SEQ ID NO: 2012 - DNA, 200 bp, Conyza canadensis
tcttgaagcaaactcatctggttatttatgccggccaaagcaatgtgcatcatattaccatggttactatgaccagcaaacccattctgacttgttctgggaaggttatgactcgtttctttaagagatgcacttatgacatcaggcaaaaattgaagagatttaataataaccatagctccccatttcttgtcttccaa

SEQ ID NO: 2013 - DNA, 200 bp, Conyza canadensis
ataaccagatgagtttgcttcaagacaggtatgtgatgataatgttacatgaaaagataccatcaaacctgctttatgatctttgtgtcatgctcaagaaacaaaataactggataaatataaaaactgagacccatcatcattcgatgatgcatgccatgttaacagtcggtagatttgatggcttattcattagctgg

SEQ ID NO: 2014 - DNA, 200 bp, Conyza canadensis
ccagctaatgaataagccatcaaatctaccgactgttaacatggcatgcatcatcgaatgatgatgggtctcagtttttatatttatccagttattttgtttcttgagcatgacacaaagatcataaagcaggtttgatggtatcttttcatgtaacattatcatcacatacctgtcttgaagcaaactcatctggttat

SEQ ID NO: 2015 - DNA, 200 bp, Conyza canadensis
atttgatggcttattcattagctggtgacatatatttgccctgttgatgttatgttcacttgttatgtgatgaactgtagtggtgatgaggatcaggctcaagagagagtcaacaggttagcaaaaatactcaaagataaagaagtaagctcgagtcttaaaaacgcagggtatggagtgatcagttgtataatacaaag

SEQ ID NO: 2016 - DNA, 200 bp, Conyza canadensis
ctttgtattatacaactgatcactccataccctgcgtttttaagactcgagcttacttctttatctttgagtatttttgctaacctgttgactctctcttgagcctgatcctcatcaccactacagttcatcacataacaagtgaacataacatcaacagggcaaatatatgtcaccagctaatgaataagccatcaaat

SEQ ID NO: 2017 - DNA, 200 bp, Conyza canadensis
gagtgatcagttgtataatacaaagagatgaagggagaggccccatgagacactcatttcactggtcagaagagaatcattattatattgaagagccattattgcgtcacttggagcctccattatcgacatatcttgaactggtttgtgctcaaaagacccttcataatttttcaattcattaataatattataatacc

SEQ ID NO: 2018 - DNA, 200 bp, Conyza canadensis
ggtattataatattattaatgaattgaaaaattatgaagggtcttttgagcacaaaccagttcaagatatgtcgataatggaggctccaagtgacgcaataatggctcttcaatataataatgattctcttctgaccagtgaaatgagtgtctcatggggcctctcccttcatctctttgtattatacaactgatcactc

SEQ ID NO: 2019 - DNA, 200 bp, Conyza canadensis
aattcattaataatattataataccaatgaagttgtaaatgtattgcttatgcaggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttct

SEQ ID NO: 2020 - DNA, 200 bp, Conyza canadensis
agaaccattcctttgttggatgccttataagagttctaagaaacattctttgtaccggaagtggtttagcatcaacagtatacatgtgccattgacggtcacgcgacggagtgtactttatattatcatagcccttaagtttgtcctgcataagcaatacatttacaacttcattggtattataatattattaatgaatt

SEQ ID NO: 2021 - DNA, 200 bp, Conyza canadensis
aggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaa

SEQ ID NO: 2022 - DNA, 200 bp, Conyza canadensis
ttcaatacatataggtacatatgagcatggtcagacttgacagtagcattatgaacatgaagttccaactcctccatagccgtcactaatgatctcaagatgctccttgatgtaaaagggagatttaactgagaccgtgggccctcatcttctgaaccttggtaacctgagggcgagaaccattcctttgttggatgcct

SEQ ID NO: 2023 - DNA, 200 bp, Conyza canadensis
ctcatatgtacctatatgtattgaaggagcaacaaattggtgatcttgttccatacacaacgtaagtattcatgtcatcttcatgaatttttttttatcatatgcactcatttaacaatggtaatatgttgtgaacaggagagtggatgtagattctgggacagaagattgcgtggttgagacacttttggtaaggctgg

SEQ ID NO: 2024 - DNA, 200 bp, Conyza canadensis
ccagccttaccaaaagtgtctcaaccacgcaatcttctgtcccagaatctacatccactctcctgttcacaacatattaccattgttaaatgagtgcatatgataaaaaaaaattcatgaagatgacatgaatacttacgttgtgtatggaacaagatcaccaatttgttgctccttcaatacatataggtacatatgag

SEQ ID NO: 2025 - DNA, 200 bp, Conyza canadensis
gttgagacacttttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtaagtcattagataggattata

SEQ ID NO: 2026 - DNA, 200 bp, Conyza canadensis
tataatcctatctaatgacttacatgcacaacgcaggtatgaccagtcacatttgtgaccacaaccctccacgcaccgttggcttgacccgatgatgccatgcaaagcttcacctcccactcaaaaactcccaaccggtgcatctttacaccaaccattgaatggatttcacgagccagccttaccaaaagtgtctcaac

SEQ ID NO: 2027 - DNA, 200 bp, Conyza canadensis
atgtaagtcattagataggattatagacatttcagcaatacccctcaaacatgcttttacctaaagtcaattgctgcaattttgatttaggtatatcgtgaactggaagatactggtttgcacaaggtgtatcatgctacctctacattgggtcctttgcatggcgtacctgtgaatacaccctttcagcctttaggatt

SEQ ID NO: 2028 - DNA, 200 bp, Conyza canadensis
aatcctaaaggctgaaagggtgtattcacaggtacgccatgcaaaggacccaatgtagaggtagcatgatacaccttgtgcaaaccagtatcttccagttcacgatatacctaaatcaaaattgcagcaattgactttaggtaaaagcatgtttgaggggtattgctgaaatgtctataatcctatctaatgacttacat

SEQ ID NO: 2029 - DNA, 200 bp, Conyza canadensis
atacaccctttcagcctttaggattacttgatcagaagcgtcttttggcaaggaaaagcaatactacgtactgctacgactttgcactggtataactatcattttgctctttcaatgcttgatggtcacctaaatttgattgtacagaaacacttattaccatatctatatttccaggcatttgaagcagctcttgagaa

SEQ ID NO: 2030 - DNA, 200 bp, Conyza canadensis
ttctcaagagctgcttcaaatgcctggaaatatagatatggtaataagtgtttctgtacaatcaaatttaggtgaccatcaagcattgaaagagcaaaatgatagttataccagtgcaaagtcgtagcagtacgtagtattgcttttccttgccaaaagacgcttctgatcaagtaatcctaaaggctgaaagggtgtat

SEQ ID NO: 2031 - DNA, 200 bp, Conyza canadensis
aggcatttgaagcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcact

SEQ ID NO: 2032 - DNA, 200 bp, Conyza canadensis
agtgcagaggtccatagtccacgccaccatgcccaccttgttttgccctggctcacgatttactgcaacaaggggagttccccatgagccacttggctcagcaaacatgagctccgtcacattcacaagtttacccttaggcctgctatcacttacgactttcgacgcccagatattctcaagagctgcttcaaatgcct

SEQ ID NO: 2033 - DNA, 200 bp, Conyza canadensis
ggcgtggactatggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcgg

SEQ ID NO: 2034 - DNA, 200 bp, Conyza canadensis
ccgctccgatacgggcccccgagtttgctgccaagtatattagtggcagtttcttggcacaagcgagatcagtaactgcctcaaaaaaggcatcctcaagaggaccaaaagatccatttttgaacgtaacatcgtttgctactaccaaaatcgttcttccatcaggaaactcaggagtgcagaggtccatagtccacgcc

SEQ ID NO: 2035 - DNA, 200 bp, Conyza canadensis
aactcgggggcccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgt

SEQ ID NO: 2036 - DNA, 200 bp, Conyza canadensis
acaatagtatcgatgacatatcttgtttcgccatttgatagatgaacctcatgagctattacagatgatttgatgtgggtataatcttcaggagtaagatacaaatactggaatcccgattcaggagtcgactcatcagaccacccaattctaaagcaagatctgacttcctcagccgctccgatacgggcccccgagtt

SEQ ID NO: 2037 - DNA, 200 bp, Conyza canadensis
caagatatgtcatcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaa

SEQ ID NO: 2038 - DNA, 200 bp, Conyza canadensis
ttgatcaagccgctgtatgcaccgcatcccaagacgtgccagatatgcgcctatcccaactgttcttccagtaacatatgttaatgtaaacgtttccttatatgctttcgaataggcaccagcaattgccccgctaccactcaaattttcaaccccgagtccgtcttcttttcccacaatagtatcgatgacatatcttg

SEQ ID NO: 2039 - DNA, 200 bp, Conyza canadensis
gcggtgcatacagcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttc

SEQ ID NO: 2040 - DNA, 200 bp, Conyza canadensis
gaacaaagctcaaccaattcaagatagctgagacaccttcgagatcatcggacaccgttaaatggacaacaccattcgtagccataattttaggcccacctagttgcatctgtgagctataaacctctcggcccaaaagcttgttcagtgcagaaaaacccgttaatataatcggttgatcaagccgctgtatgcaccgc

SEQ ID NO: 2041 - DNA, 200 bp, Conyza canadensis
atcttgaattggttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacatt

SEQ ID NO: 2042 - DNA, 200 bp, Conyza canadensis
aatgtctccacaaaactgtctctatcgaaaatcccaccagcccattcaccgttgctatccacgaccccacaaatagctgcccgaggatcacatgagttttcagggaggtactcaacgggcctttctggtggatccacaggtgctaaaacaggaagtgggccaccgacataaggtggaacaaagctcaaccaattcaagat

SEQ ID NO: 2043 - DNA, 200 bp, Conyza canadensis
atagagacagttttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattcc

SEQ ID NO: 2044 - DNA, 200 bp, Conyza canadensis
ggaatccgggaaccagacctgacctgcttgaggaacaacacgttcgtgtgaatcaagctgcccgggatctgcaggtatttcttgcatcactgtttgtgtctcaacagcaacgatcccgactgggatcccgccaagtttggcacgacccgttacgactgtcctcgcccaaccttccaatgtctccacaaaactgtctctat

SEQ ID NO: 2045 - DNA, 200 bp, Conyza canadensis
aggtcaggtctggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtat

SEQ ID NO: 2046 - DNA, 200 bp, Conyza canadensis
atacaaaaacaggctggttatatgttctgagattctcaacaattgttgaccctgcttgtaaaatcccttcaaaaagatcccgctgacctgcagaaaagcctcgccagttagccatgatgaaaagtgggagctcttctcggttgaaatccatcaatgcctgagctgttttgctggcggaatccgggaaccagacctgacct

SEQ ID NO: 2047 - DNA, 200 bp, Conyza canadensis
acatataaccagcctgtttttgtatacatcccgaaaactggagaacttcgtggtggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcg

SEQ ID NO: 2048 - DNA, 200 bp, Conyza canadensis
cgacccatacagtctatcaattctttgtttcggaacttaatctcaatcataccttcaggttcaaggacatttccttttgctgtggtttctgcatacatttctatatgatctgaattgattcgactgtcgacaaccacccatgcaccaccacgaagttctccagttttcgggatgtatacaaaaacaggctggttatatgt

SEQ ID NO: 2049 - DNA, 200 bp, Conyza canadensis
aagaattgatagactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtg

SEQ ID NO: 2050 - DNA, 200 bp, Conyza canadensis
cacacctttttcagccattcgcaatgatgtgtcatgaagttcagcgaatttggtagcaatttgagtgtaaatcggtaaaagctgtttttcacgagattttatctgttggacgatcgtttgatcgtactttgtttctcgaagtctttctttaaggcttcgaatctgtggatctagacgacccatacagtctatcaattctt

SEQ ID NO: 2051 - DNA, 200 bp, Conyza canadensis
attgcgaatggctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaag

SEQ ID NO: 2052 - DNA, 200 bp, Conyza canadensis
cttcagttttcgattccaaaaaccatttcttaatcaactcatgagcagacttgtaggaaagagtatcaccagcagcttcacgagcactactgatcaaggaagcctctgcgagcctacgacgaagccttttgtaaaagaaaaaccgagatactttccagtcaacaacttgtttgaccacacctttttcagccattcgcaat

SEQ ID NO: 2053 - DNA, 200 bp, Conyza canadensis
tggtttttggaatcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggt

SEQ ID NO: 2054 - DNA, 200 bp, Conyza canadensis
acctcttgcaaaagtgcggcgaggccttgtggtaaagcttgtagatccaatggtgaattaccaatctttaataactgatccaagagcttctgagtacgtagcttggctaacttgtcattatagttcatcagattgtctttccaagtgaaaaaagcatcatcactaagccataaatcttcagttttcgattccaaaaacca

SEQ ID NO: 2055 - DNA, 200 bp, Conyza canadensis
gcctcgccgcacttttgcaagaggtgaacaaactctcttttattttcccttagaactatttaatttaattatctatgaatgcgcaaaaacaacagttttatttaaatatttttctttcactatgctgcaggtggatccagtgaccaaaaataaactagtcgaagaactcttgcgcgtaattaagtaggtaattatacaca

SEQ ID NO: 2056 - DNA, 200 bp, Conyza canadensis
tgtgtataattacctacttaattacgcgcaagagttcttcgactagtttatttttggtcactggatccacctgcagcatagtgaaagaaaaatatttaaataaaactgttgtttttgcgcattcatagataattaaattaaatagttctaagggaaaataaaagagagtttgttcacctcttgcaaaagtgcggcgaggc

SEQ ID NO: 2057 - DNA, 200 bp, Conyza canadensis
gtaattaagtaggtaattatacacaaagctcatcagattctttctttgtttgtcaaagtgagaagccttttgagcagtgtacattataagtaggtgtcataagaaaacaggctcaaaatagtttaaagtatatgaggtttaccatgttcagattgttttatttttcttcataaattgtataataccatcacatttctatc

SEQ ID NO: 2058 - DNA, 200 bp, Conyza canadensis
gatagaaatgtgatggtattatacaatttatgaagaaaaataaaacaatctgaacatggtaaacctcatatactttaaactattttgagcctgttttcttatgacacctacttataatgtacactgctcaaaaggcttctcactttgacaaacaaagaaagaatctgatgagctttgtgtataattacctacttaattac

SEQ ID NO: 2059 - DNA, 200 bp, Conyza canadensis
tgtataataccatcacatttctatcgcattttttatatatctatatataaatggtcattttttattttattttatttttataaaaggttctctttgaccatctttgtgtttccttttggctcttcttgtccatcttcagttcttctccttccttcgctttcttttcgtctcttgagttatcttttctttatcttctcatc

SEQ ID NO: 2060 - DNA, 200 bp, Conyza canadensis
gatgagaagataaagaaaagataactcaagagacgaaaagaaagcgaaggaaggagaagaactgaagatggacaagaagagccaaaaggaaacacaaagatggtcaaagagaaccttttataaaaataaaataaaataaaaaatgaccatttatatatagatatataaaaaatgcgatagaaatgtgatggtattataca

SEQ ID NO: 2061 - DNA, 200 bp, Conyza canadensis
gttatcttttctttatcttctcatcgtgtacggattacgttgatatgagcacatatggcaaagttgattcagataactccacaacaaattttcacttgatttttgaatgtttataagcttacaatacatccatgcactcatgttcatctgctaaatgtactagtacataatcaagttaaaaacttcaacccaagaacact

SEQ ID NO: 2062 - DNA, 200 bp, Conyza canadensis
agtgttcttgggttgaagtttttaacttgattatgtactagtacatttagcagatgaacatgagtgcatggatgtattgtaagcttataaacattcaaaaatcaagtgaaaatttgttgtggagttatctgaatcaactttgccatatgtgctcatatcaacgtaatccgtacacgatgagaagataaagaaaagataac

SEQ ID NO: 2063 - DNA, 200 bp, Conyza canadensis
ttaaaaacttcaacccaagaacactattccactaaaaatttcggcatgatctcatcataaaatctacaatcattgtttattgtcaaccatcaaagacctgtagaatactaatgaacaattgcaacaagtgaacagtttgccccttgttactgttgaatgaatatttcaaagatcatgatcgagcctcgatcttgaccagc

SEQ ID NO: 2064 - DNA, 200 bp, Conyza canadensis
gctggtcaagatcgaggctcgatcatgatctttgaaatattcattcaacagtaacaaggggcaaactgttcacttgttgcaattgttcattagtattctacaggtctttgatggttgacaataaacaatgattgtagattttatgatgagatcatgccgaaatttttagtggaatagtgttcttgggttgaagtttttaa

SEQ ID NO: 2065 - DNA, 200 bp, Conyza canadensis
tgatcgagcctcgatcttgaccagcactgaaacattataaaaacaacttccattttaaatgtttgtctaatatagggaagtgagagtcaggtagcccacaatgttttagaccccagagctacttgttctggctgtggggttaaatatagttatatagacttatgttaagtgcaggcattacacacttttttgcattatat

SEQ ID NO: 2066 - DNA, 200 bp, Conyza canadensis
atataatgcaaaaaagtgtgtaatgcctgcacttaacataagtctatataactatatttaaccccacagccagaacaagtagctctggggtctaaaacattgtgggctacctgactctcacttccctatattagacaaacatttaaaatggaagttgtttttataatgtttcagtgctggtcaagatcgaggctcgatca

SEQ ID NO: 2067 - DNA, 200 bp, Conyza canadensis
cattacacacttttttgcattatatgtttacgcgcagatatatgtatttgtgaccagttaaaccggtgtgcttctcttttctgtgtaatgagctctgttatgcagtttcgggtttgagtcgctttgtgataattttgtatgtgttactggcccggccagataaatgatcggttgatataggctggttctagtcacactag

SEQ ID NO: 2068 - DNA, 200 bp, Conyza canadensis
ctagtgtgactagaaccagcctatatcaaccgatcatttatctggccgggccagtaacacatacaaaattatcacaaagcgactcaaacccgaaactgcataacagagctcattacacagaaaagagaagcacaccggtttaactggtcacaaatacatatatctgcgcgtaaacatataatgcaaaaaagtgtgtaatg

SEQ ID NO: 2069 - DNA, 200 bp, Conyza canadensis
tataggctggttctagtcacactagacgctgattagtggttaggcttcgatgtataaatcaaagttatagctacattcaaatcattattataattatttctatttcattcaaagtaggaagattatatcatacataaatatgacacagaggatgaatttcataaacttcaattctacttttcattaaaagcttaatttat

SEQ ID NO: 2070 - DNA, 200 bp, Conyza canadensis
ataaattaagcttttaatgaaaagtagaattgaagtttatgaaattcatcctctgtgtcatatttatgtatgatataatcttcctactttgaatgaaatagaaataattataataatgatttgaatgtagctataactttgatttatacatcgaagcctaaccactaatcagcgtctagtgtgactagaaccagcctata

SEQ ID NO: 2071 - DNA, 200 bp, Conyza canadensis
acttttcattaaaagcttaatttatctagttgcccggtttcccattcttcttcccgttgccgccaccaggccttttactccaccatggccaccccctccttccccaaccaccaaatggatatccaccccagatacctggccatccaccacctggccaaaatccgccaccaggaaaatatccaccacctggccaataaccc

SEQ ID NO: 2072 - DNA, 200 bp, Conyza canadensis
gggttattggccaggtggtggatattttcctggtggcggattttggccaggtggtggatggccaggtatctggggtggatatccatttggtggttggggaaggagggggtggccatggtggagtaaaaggcctggtggcggcaacgggaagaagaatgggaaaccgggcaactagataaattaagcttttaatgaaaagt

SEQ ID NO: 2073 - DNA, 200 bp, Conyza canadensis
atatccaccacctggccaataacccccataatacggatatgatgggtcatagccccctccatatcctttacctcttcctggtccaccgtaccctccatatccatcacccgaatcataacctccccctccaccatatctgccaccatgatcttttccacgtccttcatcataaccaccatcttctccaccatgatcttttc

SEQ ID NO: 2074 - DNA, 200 bp, Conyza canadensis
gaaaagatcatggtggagaagatggtggttatgatgaaggacgtggaaaagatcatggtggcagatatggtggagggggaggttatgattcgggtgatggatatggagggtacggtggaccaggaagaggtaaaggatatggagggggctatgacccatcatatccgtattatgggggttattggccaggtggtggatat

SEQ ID NO: 2075 - DNA, 200 bp, Conyza canadensis
ccatcttctccaccatgatcttttccacgtccttcatcgtcgtcccctttgccttcatgatcaccatcttcaccaccatgatcttctccaggttcatcatcatcatggtcatcgccttttcccccttcatcaccatgatctcttcctggtccatcttgtccaccaccttcatgatcaccaccttcatcaccatgatcttg

SEQ ID NO: 2076 - DNA, 200 bp, Conyza canadensis
caagatcatggtgatgaaggtggtgatcatgaaggtggtggacaagatggaccaggaagagatcatggtgatgaagggggaaaaggcgatgaccatgatgatgatgaacctggagaagatcatggtggtgaagatggtgatcatgaaggcaaaggggacgacgatgaaggacgtggaaaagatcatggtggagaagatgg

SEQ ID NO: 2077 - DNA, 200 bp, Conyza canadensis
ctactttcgccggcttctggagttatacagtttaagatgtctgaaggtcaagcaatgcatgctggtgagctaatagcaaggcttgatcttgatgacccatcagcagtaagaaaagcagagcctttccatggaacttttcctcttcttgggtcttcaactgccatgtcagataaagttcatcaaaagtgtgctacaactct

SEQ ID NO: 2078 - DNA, 200 bp, Conyza canadensis
agagttgtagcacacttttgatgaactttatctgacatggcagttgaagacccaagaagaggaaaagttccatggaaaggctctgcttttcttactgctgatgggtcatcaagatcaagccttgctattagctcaccagcatgcattgcttgaccttcagacatcttaaactgtataactccagaagccggcgaaagtag

SEQ ID NO: 2079 - DNA, 200 bp, Conyza canadensis
ttcatcaaaagtgtgctacaactctaagtgccgctcgaatgattcttgcaggctatgatcacgatattgatgaagttgtcaaaaaccttcttcgttgtctagataatcccaagctacctttcctccagtggcaagaatgctttgcagttctagccaatcgtctccctaaagatctaagaaacaagttggaatccaagttt

SEQ ID NO: 2080 - DNA, 200 bp, Conyza canadensis
aaacttggattccaacttgtttcttagatctttagggagacgattggctagaactgcaaagcattcttgccactggaggaaaggtagcttgggattatctagacaacgaagaaggtttttgacaacttcatcaatatcgtgatcatagcctgcaagaatcattcgagcggcacttagagttgtagcacacttttgatgaa

SEQ ID NO: 2081 - DNA, 200 bp, Conyza canadensis
aagaaacaagttggaatccaagtttaaggagtacgaaggaatttccacacaacaaactattgactttcctgctagagttctacgggtcattcttgaaacccatcttggatcttgctcagaaaaagaaaagggagcccaagaaaggctcgttgagccattaatgggtcttgtaaagtcatatgaagggggaagagaaagtc

SEQ ID NO: 2082 - DNA, 200 bp, Conyza canadensis
gactttctcttcccccttcatatgactttacaagacccattaatggctcaacgagcctttcttgggctcccttttctttttctgagcaagatccaagatgggtttcaagaatgacccgtagaactctagcaggaaagtcaatagtttgttgtgtggaaattccttcgtactccttaaacttggattccaacttgtttctt

SEQ ID NO: 2083 - DNA, 200 bp, Conyza canadensis
tcatatgaagggggaagagaaagtcatgcacgtgggatcgttcatgctctatttgatgaatatttatctgttgaagagttgttcagcgacaacattcaggctgatgtaatcgaacgtcttcgacaactatacaagaaagatctcttgaggattgtcgacattgtcctttcccatcagggtgttaggagtaaaaacaaatt

SEQ ID NO: 2084 - DNA, 200 bp, Conyza canadensis
aatttgtttttactcctaacaccctgatgggaaaggacaatgtcgacaatcctcaagagatctttcttgtatagttgtcgaagacgttcgattacatcagcctgaatgttgtcgctgaacaactcttcaacagataaatattcatcaaatagagcatgaacgatcccacgtgcatgactttctcttcccccttcatatga

SEQ ID NO: 2085 - DNA, 200 bp, Conyza canadensis
agggtgttaggagtaaaaacaaattgatactacggctgatggagcatttggtttaccccaatccggctgcgtatagggagaaactgatacgattttctcaacttaaccacacaagttattctgagttagcactgaaggcaagtcaacttttagaacaaactaaactaagtgaacttcgttcaagcattgcgcgaagtctt

SEQ ID NO: 2086 - DNA, 200 bp, Conyza canadensis
aagacttcgcgcaatgcttgaacgaagttcacttagtttagtttgttctaaaagttgacttgccttcagtgctaactcagaataacttgtgtggttaagttgagaaaatcgtatcagtttctccctatacgcagccggattggggtaaaccaaatgctccatcagccgtagtatcaatttgtttttactcctaacaccct

SEQ ID NO: 2087 - DNA, 200 bp, Conyza canadensis
tcgttcaagcattgcgcgaagtctttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacct

SEQ ID NO: 2088 - DNA, 200 bp, Conyza canadensis
aggtctcaacaacacgcctttgaagggtgtgatcgctatggtcaaaaagaccaacaagggcatcttcaactgccaatggagcactcacaatatcctccattctttcattaatggcactcttcctcttaggggtatccatattttcaccttcttcagtaaacatctctaattcagaaagacttcgcgcaatgcttgaacga

SEQ ID NO: 2089 - DNA, 200 bp, Conyza canadensis
cttcaaaggcgtgttgttgagacctatgttcgaagattatatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggt

SEQ ID NO: 2090 - DNA, 200 bp, Conyza canadensis
accatagctccccatttcttgtcttccaagggagcttcattctgttcatagtcaggcacattaacttctccaatgagtccttctataaattgccatgtagcgatgagtccggatctgtgccactgcattctaacactccccttcacgagatatggctgatataatcttcgaacataggtctcaacaacacgcctttgaag

SEQ ID NO: 2091 - DNA, 200 bp, Conyza canadensis
aagacaagaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacagt

SEQ ID NO: 2092 - DNA, 200 bp, Conyza canadensis
actgtcttgaagcaaactcatctggttatttatgccggccaaagcaatgtgcatcatattaccatggttactatgaccagcaaacccattctgacttgttctgggaaggttatgactcgtttctttaagagatgcacttatgacatcaggcaaaaattgaagagatttaataataaccatagctccccatttcttgtctt

SEQ ID NO: 2093 - DNA, 200 bp, Conyza canadensis
ccagatgagtttgcttcaagacagtggtgatgaggatcaggctcaagagagagtcaacaggttagcaaaaatactcaaagataaagaagtaagctcgagtcttaaaaacgcagggtatggagtgatcagttgtataatacaaagagatgaagggagaggccccatgagacactcatttcactggtcagaagagaatcatt

SEQ ID NO: 2094 - DNA, 200 bp, Conyza canadensis
aatgattctcttctgaccagtgaaatgagtgtctcatggggcctctcccttcatctctttgtattatacaactgatcactccataccctgcgtttttaagactcgagcttacttctttatctttgagtatttttgctaacctgttgactctctcttgagcctgatcctcatcaccactgtcttgaagcaaactcatctgg

SEQ ID NO: 2095 - DNA, 200 bp, Conyza canadensis
tttcactggtcagaagagaatcattattatattgaagagccattattgcgtcacttggagcctccattatcgacatatcttgaactggacaaacttaagggctatgataatataaagtacactccgtcgcgtgaccgtcaatggcacatgtatactgttgatgctaaaccacttccggtacaaagaatgtttcttagaac

SEQ ID NO: 2096 - DNA, 200 bp, Conyza canadensis
gttctaagaaacattctttgtaccggaagtggtttagcatcaacagtatacatgtgccattgacggtcacgcgacggagtgtactttatattatcatagcccttaagtttgtccagttcaagatatgtcgataatggaggctccaagtgacgcaataatggctcttcaatataataatgattctcttctgaccagtgaaa

SEQ ID NO: 2097 - DNA, 200 bp, Conyza canadensis
cggtacaaagaatgtttcttagaactcttataaggcatccaacaaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtct

SEQ ID NO: 2098 - DNA, 200 bp, Conyza canadensis
agacttgacagtagcattatgaacatgaagttccaactcctccatagccgtcactaatgatctcaagatgctccttgatgtaaaagggagatttaactgagaccgtgggccctcatcttctgaaccttggtaacctgagggcgagaaccattcctttgttggatgccttataagagttctaagaaacattctttgtaccg

SEQ ID NO: 2099 - DNA, 200 bp, Conyza canadensis
tgttcataatgctactgtcaagtctgaccatgctcatatgtacctatatgtattgaaggagcaacaaattggtgatcttgttccatacacaacgagagtggatgtagattctgggacagaagattgcgtggttgagacacttttggtaaggctggctcgtgaaatccattcaatggttggtgtaaagatgcaccggttgg

SEQ ID NO: 2100 - DNA, 200 bp, Conyza canadensis
ccaaccggtgcatctttacaccaaccattgaatggatttcacgagccagccttaccaaaagtgtctcaaccacgcaatcttctgtcccagaatctacatccactctcgttgtgtatggaacaagatcaccaatttgttgctccttcaatacatataggtacatatgagcatggtcagacttgacagtagcattatgaaca

SEQ ID NO: 2101 - DNA, 200 bp, Conyza canadensis
gttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtatatcgtgaactggaagatactggtttgcacaaggtgtatcatgctacctctacattgggtccttt

SEQ ID NO: 2102 - DNA, 200 bp, Conyza canadensis
aaaggacccaatgtagaggtagcatgatacaccttgtgcaaaccagtatcttccagttcacgatatacatgcacaacgcaggtatgaccagtcacatttgtgaccacaaccctccacgcaccgttggcttgacccgatgatgccatgcaaagcttcacctcccactcaaaaactcccaaccggtgcatctttacaccaac

SEQ ID NO: 2103 - DNA, 200 bp, Conyza canadensis
atgctacctctacattgggtcctttgcatggcgtacctgtgaatacaccctttcagcctttaggattacttgatcagaagcgtcttttggcaaggaaaagcaatactacgtactgctacgactttgcactggcatttgaagcagctcttgagaatatctgggcgtcgaaagtcgtaagtgatagcaggcctaagggtaaa

SEQ ID NO: 2104 - DNA, 200 bp, Conyza canadensis
tttacccttaggcctgctatcacttacgactttcgacgcccagatattctcaagagctgcttcaaatgccagtgcaaagtcgtagcagtacgtagtattgcttttccttgccaaaagacgcttctgatcaagtaatcctaaaggctgaaagggtgtattcacaggtacgccatgcaaaggacccaatgtagaggtagcat

SEQ ID NO: 2105 - DNA, 200 bp, Conyza canadensis
aagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcctgatggaagaacgattttggtagtagcaaacgatg

SEQ ID NO: 2106 - DNA, 200 bp, Conyza canadensis
catcgtttgctactaccaaaatcgttcttccatcaggaaactcaggagtgcagaggtccatagtccacgccaccatgcccaccttgttttgccctggctcacgatttactgcaacaaggggagttccccatgagccacttggctcagcaaacatgagctccgtcacattcacaagtttacccttaggcctgctatcactt

SEQ ID NO: 2107 - DNA, 200 bp, Conyza canadensis
acgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtcagatcttgctttagaattgggtggtctgatgagtc

SEQ ID NO: 2108 - DNA, 200 bp, Conyza canadensis
gactcatcagaccacccaattctaaagcaagatctgacttcctcagccgctccgatacgggcccccgagtttgctgccaagtatattagtggcagtttcttggcacaagcgagatcagtaactgcctcaaaaaaggcatcctcaagaggaccaaaagatccatttttgaacgtaacatcgtttgctactaccaaaatcgt

SEQ ID NO: 2109 - DNA, 200 bp, Conyza canadensis
ttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaagacggactcggggttgaaaatttgagtggtagcggg

SEQ ID NO: 2110 - DNA, 200 bp, Conyza canadensis
cccgctaccactcaaattttcaaccccgagtccgtcttcttttcccacaatagtatcgatgacatatcttgtttcgccatttgatagatgaacctcatgagctattacagatgatttgatgtgggtataatcttcaggagtaagatacaaatactggaatcccgattcaggagtcgactcatcagaccacccaattctaa

SEQ ID NO: 2111 - DNA, 200 bp, Conyza canadensis
ggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatattaacgggtttttctgcactgaacaagcttttgggcc

SEQ ID NO: 2112 - DNA, 200 bp, Conyza canadensis
ggcccaaaagcttgttcagtgcagaaaaacccgttaatataatcggttgatcaagccgctgtatgcaccgcatcccaagacgtgccagatatgcgcctatcccaactgttcttccagtaacatatgttaatgtaaacgtttccttatatgctttcgaataggcaccagcaattgccccgctaccactcaaattttcaacc

SEQ ID NO: 2113 - DNA, 200 bp, Conyza canadensis
tctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtcggtggcccacttcctgttttagcacctgtggatcc

SEQ ID NO: 2114 - DNA, 200 bp, Conyza canadensis
ggatccacaggtgctaaaacaggaagtgggccaccgacataaggtggaacaaagctcaaccaattcaagatagctgagacaccttcgagatcatcggacaccgttaaatggacaacaccattcgtagccataattttaggcccacctagttgcatctgtgagctataaacctctcggcccaaaagcttgttcagtgcaga

SEQ ID NO: 2115 - DNA, 200 bp, Conyza canadensis
ttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttgggcgaggacagtcgtaacgggtcgtgccaaacttggc

SEQ ID NO: 2116 - DNA, 200 bp, Conyza canadensis
gccaagtttggcacgacccgttacgactgtcctcgcccaaccttccaatgtctccacaaaactgtctctatcgaaaatcccaccagcccattcaccgttgctatccacgaccccacaaatagctgcccgaggatcacatgagttttcagggaggtactcaacgggcctttctggtggatccacaggtgctaaaacaggaa

SEQ ID NO: 2117 - DNA, 200 bp, Conyza canadensis
cgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaacagctcaggcattgatggatttcaaccgagaagagc

SEQ ID NO: 2118 - DNA, 200 bp, Conyza canadensis
gctcttctcggttgaaatccatcaatgcctgagctgttttgctggcggaatccgggaaccagacctgacctgcttgaggaacaacacgttcgtgtgaatcaagctgcccgggatctgcaggtatttcttgcatcactgtttgtgtctcaacagcaacgatcccgactgggatcccgccaagtttggcacgacccgttacg

SEQ ID NO: 2119 - DNA, 200 bp, Conyza canadensis
ttgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaaactggagaacttcgtggcggtgcatgggtggttgt

SEQ ID NO: 2120 - DNA, 200 bp, Conyza canadensis
acaaccacccatgcaccgccacgaagttctccagttttcgggatgtatacaaaaacaggctggttatatgttctgagattctcaacaattgttgaccctgcttgtaaaatcccttcaaaaagatcccgctgacctgcagaaaagcctcgccagttagccatgatgaaaagtgggagctcttctcggttgaaatccatcaa

SEQ ID NO: 2121 - DNA, 200 bp, Conyza canadensis
ttcgtggcggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccacagattcgaagccttaaagaaagacttcgagaaaca

SEQ ID NO: 2122 - DNA, 200 bp, Conyza canadensis
tgtttctcgaagtctttctttaaggcttcgaatctgtggatctagacgacccatacagtctatcaattctttgtttcggaacttaatctcaatcataccttcaggttcaaggacatttccttttgctgtggtttctgcatacatttctatatgatctgaattgattcgactgtcgacaaccacccatgcaccgccacgaa

SEQ ID NO: 2123 - DNA, 200 bp, Conyza canadensis
ccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagttgttgactggaaagtatctcggtttttcttttaca

SEQ ID NO: 2124 - DNA, 200 bp, Conyza canadensis
tgtaaaagaaaaaccgagatactttccagtcaacaacttgtttgaccacacctttttcagccattcgcaatgatgtgtcatgaagttcagcgaatttggtagcaatttgagtgtaaatcggtaaaagctgtttttcacgagattttatctgttggacgatcgtttgatcgtactttgtttctcgaagtctttctttaagg

SEQ ID NO: 2125 - DNA, 200 bp, Conyza canadensis
aaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggcttagtgatgatgcttttttcacttggaaagacaatct

SEQ ID NO: 2126 - DNA, 200 bp, Conyza canadensis
agattgtctttccaagtgaaaaaagcatcatcactaagccataaatcttcagttttcgattccaaaaaccatttcttaatcaactcatgagcagacttgtaggaaagagtatcaccagcagcttcacgagcactactgatcaaggaagcctctgcgagcctacgacgaagccttttgtaaaagaaaaaccgagatacttt

SEQ ID NO: 2127 - DNA, 200 bp, Conyza canadensis
cttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtggatccagtgaccaaaaataaactagtcgaagaactcttgcgcgta

SEQ ID NO: 2128 - DNA, 200 bp, Conyza canadensis
tacgcgcaagagttcttcgactagtttatttttggtcactggatccacctcttgcaaaagtgcggcgaggccttgtggtaaagcttgtagatccaatggtgaattaccaatctttaataactgatccaagagcttctgagtacgtagcttggctaacttgtcattatagttcatcagattgtctttccaagtgaaaaaag

SEQ ID NO: 2129 - DNA, 200 bp, Conyza canadensis
actagtcgaagaactcttgcgcgtaattaagtaggtaattatacacaaagctcatcagattctttctttgtttgtcaaagtgagaagccttttgagcagtgtacattataagtaggtgtcataagaaaacaggctcaaaatagtttaaagtatatgaggtttaccatgttcagattgttttatttttcttcataaattgt

SEQ ID NO: 2130 - DNA, 200 bp, Conyza canadensis
acaatttatgaagaaaaataaaacaatctgaacatggtaaacctcatatactttaaactattttgagcctgttttcttatgacacctacttataatgtacactgctcaaaaggcttctcactttgacaaacaaagaaagaatctgatgagctttgtgtataattacctacttaattacgcgcaagagttcttcgactagt

SEQ ID NO: 2131 - DNA, 200 bp, Conyza canadensis
ggtcattgtgttgctgtacgtgtaacaagtgaagatccggatgatggttttaagcccaccagtggaaaagttcaggagctaagttttaaaagcaagccaaacgtatgggcatacttttctgtcaagtctggaggaggcattcatgaattctcagattctcaattcggtcatgtttttgcatttggagagtcaagaacatt

SEQ ID NO: 2132 - DNA, 200 bp, Conyza canadensis
aatgttcttgactctccaaatgcaaaaacatgaccgaattgagaatctgagaattcatgaatgcctcctccagacttgacagaaaagtatgcccatacgtttggcttgcttttaaaacttagctcctgaacttttccactggtgggcttaaaaccatcatccggatcttcacttgttacacgtacagcaacacaatgacc

SEQ ID NO: 2133 - DNA, 200 bp, Conyza canadensis
ttgcatttggagagtcaagaacattggctattgcaaatatggttcttgggctaaaggaaattcaaattcgtggcgagatgcgcactaatgttgattatacaattgatttattacatgctccagattatagagaaaacaaaatacacataccggttggttagatagccgaattgctatgagggttagagcagaaaggcccc

SEQ ID NO: 2134 - DNA, 200 bp, Conyza canadensis
ggggcctttctgctctaaccctcatagcaattcggctatctaaccaaccggtatgtgtattttgttttctctataatctggagcatgtaataaatcaattgtataatcaacattagtgcgcatctcgccacgaatttgaatttcctttagcccaagaaccatatttgcaatagccaatgttcttgactctccaaatgcaa

SEQ ID NO: 2135 - DNA, 200 bp, Conyza canadensis
tttggtggtggtttcgtggtctaattcgaagaaacgagtgagatatcggtattttaagttttccggcgaactttccgatgaaagttagccggagaagatgaagatgatgacaacagaaaattaaatttcattttttgtccctgaacttgtcacttttcgcactttaagtccctcacgtgttttgcacgtgtgggacttaa

SEQ ID NO: 2136 - DNA, 200 bp, Conyza canadensis
ttaagtcccacacgtgcaaaacacgtgagggacttaaagtgcgaaaagtgacaagttcagggacaaaaaatgaaatttaattttctgttgtcatcatcttcatcttctccggctaactttcatcggaaagttcgccggaaaacttaaaataccgatatctcactcgtttcttcgaattagaccacgaaaccaccaccaaa

SEQ ID NO: 2137 - DNA, 200 bp, Conyza canadensis
cgtgttttgcacgtgtgggacttaacggctgaaacttaacaccgtttggcgagggacgtcgattgcaaaaatctgtcaagtttagggtcaaaattgtaattttttcattttagggatgaaaagtgaaaaacgcgccaagtttagggacgaaaaatgtaatttactctaagtattatgtaatttgttttgttattaataaa

SEQ ID NO: 2138 - DNA, 200 bp, Conyza canadensis
tttattaataacaaaacaaattacataatacttagagtaaattacatttttcgtccctaaacttggcgcgtttttcacttttcatccctaaaatgaaaaaattacaattttgaccctaaacttgacagatttttgcaatcgacgtccctcgccaaacggtgttaagtttcagccgttaagtcccacacgtgcaaaacacg

SEQ ID NO: 2139 - DNA, 200 bp, Conyza canadensis
attgggtatttaaagggagatgagagggttgaaccctcggctccgtccccccttataggacaccttgttcatgaggatactttgatattttaatggggaaatgataaattcttttaaattaacctaaaaatcattctaaaactataagaagatgatatgtgatatctactaattctcttctctactctcgcccttttttc

SEQ ID NO: 2140 - DNA, 200 bp, Conyza canadensis
gaaaaaagggcgagagtagagaagagaattagtagatatcacatatcatcttcttatagttttagaatgatttttaggttaatttaaaagaatttatcatttccccattaaaatatcaaagtatcctcatgaacaaggtgtcctataaggggggacggagccgagggttcaaccctctcatctccctttaaatacccaat

SEQ ID NO: 2141 - DNA, 200 bp, Conyza canadensis
tcttctctactctcgcccttttttcacatataatcatctcattattaagaacatttttaggttatttagttaaaagaatgaatcatttctcattttaatataaatggttaatttgaattgacatcaatcactggcgagaaacacaaaggtaaaagagtagtgaacacgaaggtaaaagagtagtaaattaccaatcatat

SEQ ID NO: 2142 - DNA, 200 bp, Conyza canadensis
atatgattggtaatttactactcttttaccttcgtgttcactactcttttacctttgtgtttctcgccagtgattgatgtcaattcaaattaaccatttatattaaaatgagaaatgattcattcttttaactaaataacctaaaaatgttcttaataatgagatgattatatgtgaaaaaagggcgagagtagagaaga

SEQ ID NO: 2143 - DNA, 200 bp, Conyza canadensis
aagagtagtaaattaccaatcatatccttcctcctttatattttgatggaacaaacacaaatttattttagaattttttaaaaaaatatattaaaccgggtagaacataatcattattattgttacacgaaatttattgtacaccgtgttagctggttacagtagtattaattaattggtcaaatatatgtgcattaaaa

SEQ ID NO: 2144 - DNA, 200 bp, Conyza canadensis
ttttaatgcacatatatttgaccaattaattaatactactgtaaccagctaacacggtgtacaataaatttcgtgtaacaataataatgattatgttctacccggtttaatatatttttttaaaaaattctaaaataaatttgtgtttgttccatcaaaatataaaggaggaaggatatgattggtaatttactactctt

SEQ ID NO: 2145 - DNA, 200 bp, Conyza canadensis
ttggtcaaatatatgtgcattaaaatcaggaacacatttataacaaacatagcgagattttaggagaactttaattgaaaattttaccattacagtaattaattaacttaaacacatacaaaaccctatacattatttacattgtctacatttcattactgttgttggtttctgatcgaatgccatgaattttcgggcat

SEQ ID NO: 2146 - DNA, 200 bp, Conyza canadensis
atgcccgaaaattcatggcattcgatcagaaaccaacaacagtaatgaaatgtagacaatgtaaataatgtatagggttttgtatgtgtttaagttaattaattactgtaatggtaaaattttcaattaaagttctcctaaaatctcgctatgtttgttataaatgtgttcctgattttaatgcacatatatttgaccaa

SEQ ID NO: 2147 - DNA, 200 bp, Conyza canadensis
tcgaatgccatgaattttcgggcatttgatctgaagctcaacatttttctgggcgattcaaataagcgttttactgttacaaaaagtttcgtctcaacgggtgaccactacacgacttctgataacaccaatccgaccagtcttacaaaggtgaaggtgagcgtcaatatttagtttaatctcatcgtctgtgttttaag

SEQ ID NO: 2148 - DNA, 200 bp, Conyza canadensis
cttaaaacacagacgatgagattaaactaaatattgacgctcaccttcacctttgtaagactggtcggattggtgttatcagaagtcgtgtagtggtcacccgttgagacgaaactttttgtaacagtaaaacgcttatttgaatcgcccagaaaaatgttgagcttcagatcaaatgcccgaaaattcatggcattcga

SEQ ID NO: 2149 - DNA, 200 bp, Conyza canadensis
ttaatctcatcgtctgtgttttaagcttttttgaggtctaaacctttttggtcagcaaaatttgaaaattcttttaatatgttaacttcttttggaagctttagagatttatatattcttaatccataataatctataattctatatttctttactcctctataaagcatattgctttttttatttttggaaattaagca

SEQ ID NO: 2150 - DNA, 200 bp, Conyza canadensis
tgcttaatttccaaaaataaaaaaagcaatatgctttatagaggagtaaagaaatatagaattatagattattatggattaagaatatataaatctctaaagcttccaaaagaagttaacatattaaaagaattttcaaattttgctgaccaaaaaggtttagacctcaaaaaagcttaaaacacagacgatgagattaa

SEQ ID NO: 2151 - DNA, 200 bp, Conyza canadensis
tttttttatttttggaaattaagcattttttaaaatattttcataatacccttacacccctaccttctttctaatcattacacgctctcctcgaccttctatcaccctccgccgccgccctccttctccaccaccgccctcgatctccaccaccgcctcccttttatattgtcatcgccttttagccgttgcaacgcgcg

SEQ ID NO: 2152 - DNA, 200 bp, Conyza canadensis
cgcgcgttgcaacggctaaaaggcgatgacaatataaaagggaggcggtggtggagatcgagggcggtggtggagaaggagggcggcggcggagggtgatagaaggtcgaggagagcgtgtaatgattagaaagaaggtaggggtgtaagggtattatgaaaatattttaaaaaatgcttaatttccaaaaataaaaaaa

SEQ ID NO: 2153 - DNA, 200 bp, Conyza canadensis
cgccttttagccgttgcaacgcgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatgg

SEQ ID NO: 2154 - DNA, 200 bp, Conyza canadensis
ccatagacaaatagtttagttcagtttggacccgttcgacttacactctagagtgaatgattttagcttaaatatatattcatcagtacaaaatcataacaaaataatgaaatatataaactttacgtaaactttatgtttattacgttactacttttaatacgagcatagtgtccgcgcgttgcaacggctaaaaggcg

SEQ ID NO: 2155 - DNA, 200 bp, Conyza canadensis
actgaactaaactatttgtctatggtagtcaaattcttaatctttttggtatcgatcgttgtgtagtgttgcacacctcacttgatattagttttatgtgattatatatggttaatttaatttttctttgatttttgatcatggtcttaaatattattaaaggtgaagaaacatgtgaagagggataaatttggagaaag

SEQ ID NO: 2156 - DNA, 200 bp, Conyza canadensis
ctttctccaaatttatccctcttcacatgtttcttcacctttaataatatttaagaccatgatcaaaaatcaaagaaaaattaaattaaccatatataatcacataaaactaatatcaagtgaggtgtgcaacactacacaacgatcgataccaaaaagattaagaatttgactaccatagacaaatagtttagttcagt

SEQ ID NO: 2157 - DNA, 200 bp, Conyza canadensis
tgaagagggataaatttggagaaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttac

SEQ ID NO: 2158 - DNA, 200 bp, Conyza canadensis
gtaactataacccttacaactatgtttagcaaaatcctacttgtatagattggaaatcaaaacaactagtatacatatatgatatacctaatcaaacaaattacatataattaataaacttaaagaaggactaaccttgccatagggtgacactatctgttttagtgatgccattctttctccaaatttatccctcttca

SEQ ID NO: 2159 - DNA, 200 bp, Conyza canadensis
acatagttgtaagggttatagttacaacacaatagaatggtatacatacattatacatatataaagatatataactgtttattaataataatctttaaccgtcatgtaaaccaatttactttgctttatccatatccttaaaggctatgaatagcatagtcgatgtaagtatatggttgcttagacggtgtgttaatgtt

SEQ ID NO: 2160 - DNA, 200 bp, Conyza canadensis
aacattaacacaccgtctaagcaaccatatacttacatcgactatgctattcatagcctttaaggatatggataaagcaaagtaaattggtttacatgacggttaaagattattattaataaacagttatatatctttatatatgtataatgtatgtataccattctattgtgttgtaactataacccttacaactatgt

SEQ ID NO: 2161 - DNA, 200 bp, Conyza canadensis
gttgcttagacggtgtgttaatgttgatcttacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgag

SEQ ID NO: 2162 - DNA, 200 bp, Conyza canadensis
ctcatctctataggtatgagtaatcaagcctatttcgatgtatgtaacagaaattgttggttaaatttgaatgatattataactatgctcttaaaaataaaggaagttttacctttgcgttcgattcccttcttctctaaaacacaatggtccaagtctagactcctgtaagatcaacattaacacaccgtctaagcaac

SEQ ID NO: 2163 - DNA, 200 bp, Conyza canadensis
gattactcatacctatagagatgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaa

SEQ ID NO: 2164 - DNA, 200 bp, Conyza canadensis
ttggtaaaattaactattttatatcatctgaattccaccaagaagatgtccaactgtaattttgtaatggacatacaacaaagaaaaaaaccgcaaaccataattaactagtacattagaaatgggaaaatgatatcctacaattcaatatataaatcttcatacacacatgtcactcatctctataggtatgagtaatc

SEQ ID NO: 2165 - DNA, 200 bp, Conyza canadensis
gatataaaatagttaattttaccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaac

SEQ ID NO: 2166 - DNA, 200 bp, Conyza canadensis
gttttattagtggttcatggttggattaacaaataatagaacattgtgtcaaatctgttgtaattggaaatctgcgaattgcaaaagacaacattttatgtaatacgagtatctcttttgaaacttacaaaccatttatctacgttctaatttctctctaccaatgatgtagtgtttggtaaaattaactattttatatc

SEQ ID NO: 2167 - DNA, 200 bp, Conyza canadensis
tccaaccatgaaccactaataaaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagctttt

SEQ ID NO: 2168 - DNA, 200 bp, Conyza canadensis
aaaagctatgattggaaagaagagagaaagttggatgtgcatttttgaacctttttaagctagaataagaataaaatacatgttttttgatattactggtcattatatggagacaaaaagcatacaacaatcaataatgtattggtggcttttttttattcaagatgtttgtactgttttattagtggttcatggttgga

SEQ ID NO: 2169 - DNA, 200 bp, Conyza canadensis
tctcttctttccaatcatagcttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaac

SEQ ID NO: 2170 - DNA, 200 bp, Conyza canadensis
gttggtttttggtgaggtgccataaagttacttaaatatgtagtaggtacaaaaaacaaattggggtccaaggatgggaggtgatgcagagcacgtgacatggttaaccaactaccccccacacacatatcaatctacatccatatgtttcttttacgtgtatgcttttaatttgaaaagctatgattggaaagaagaga

SEQ ID NO: 2171 - DNA, 200 bp, Conyza canadensis
ttatggcacctcaccaaaaaccaaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaat

SEQ ID NO: 2172 - DNA, 200 bp, Conyza canadensis
atttgcttctttttttagctggtttgaaaagagacagacattgacaacaacaacaaaattgtgattaaaaacaagaaaattggaatgacagaaatctgggagagatgtaagtacttgttgaggtatatgtgtgtgtgcaattaagtgatgtatagttgggagtttggtttgtttggttggtttttggtgaggtgccataa

SEQ ID NO: 2173 - DNA, 200 bp, Conyza canadensis
aaaccagctaaaaaaagaagcaaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattga

SEQ ID NO: 2174 - DNA, 200 bp, Conyza canadensis
tcaatctttacatacccaactctacttttttgctaaactcaacaaaactgataaaaacccggttcaaaaaacacaggaatttgaagaaattaactcaaagatttaaacttggggggtgaaagaatgagaaagactaaccataaacaagtggaacaacagctgaatcaaatcaagaatttgcttctttttttagctggttt

SEQ ID NO: 2175 - DNA, 200 bp, Conyza canadensis
gtagagttgggtatgtaaagattgaatctttttactgggtttatgtaatttctttgaaatttataagtttcttgcaatgggtatatgattttctattaattgaagtggttaataacaggatttggtgagtaaagtttgaatctttcgagttatggatttatgtcataccttttcttgcccttcaaaataaagtcaaagct

SEQ ID NO: 2176 - DNA, 200 bp, Conyza canadensis
agctttgactttattttgaagggcaagaaaaggtatgacataaatccataactcgaaagattcaaactttactcaccaaatcctgttattaaccacttcaattaatagaaaatcatatacccattgcaagaaacttataaatttcaaagaaattacataaacccagtaaaaagattcaatctttacatacccaactctac

SEQ ID NO: 2177 - DNA, 200 bp, Conyza canadensis
tgcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatttgatgagttcaataataataagaaattt

SEQ ID NO: 2178 - DNA, 200 bp, Conyza canadensis
aaatttcttattattattgaactcatcaaattgaagtaatcactaatcacattaaaactttatcaggaaacaaatataacaaaattgaatttatcaaaatatatattacaatttacaaacagcatgaaaatattcatgggagcaacagcataccaaagtcaaatcacaaaactaaagctttgactttattttgaagggca

SEQ ID NO: 2179 - DNA, 200 bp, Conyza canadensis
tgagttcaataataataagaaatttagaactttgaacctcgtatttctaattcgaggtttcctagctctatgtaaaccccactatattctccattataacatacgtttatgtgttactttatttagacattttaatatttgactcaattataacataggttcagctgaaaatttaatttctttgttagtgaattgttgtg

SEQ ID NO: 2180 - DNA, 200 bp, Conyza canadensis
cacaacaattcactaacaaagaaattaaattttcagctgaacctatgttataattgagtcaaatattaaaatgtctaaataaagtaacacataaacgtatgttataatggagaatatagtggggtttacatagagctaggaaacctcgaattagaaatacgaggttcaaagttctaaatttcttattattattgaactca

SEQ ID NO: 2181 - DNA, 200 bp, Conyza canadensis
atttctttgttagtgaattgttgtgacttttttttttggtagtttgcgttgtgatagtcaggagacagaaagggcaatttgtttctgttctttttaagttagataggtgaccatttcggtagatactagatagtgcaaagatatagtgttttttgtaagtaccaagtactttatgaacttacccaatgataacaactttt

SEQ ID NO: 2182 - DNA, 200 bp, Conyza canadensis
aaaagttgttatcattgggtaagttcataaagtacttggtacttacaaaaaacactatatctttgcactatctagtatctaccgaaatggtcacctatctaacttaaaaagaacagaaacaaattgccctttctgtctcctgactatcacaacgcaaactaccaaaaaaaaaagtcacaacaattcactaacaaagaaat

SEQ ID NO: 2183 - DNA, 200 bp, Conyza canadensis
aacttacccaatgataacaacttttgatggttcagtggttcagccttctctttgtccctagactaattagtccaatctatctctcagtatatattttttaggtattgacatattttatgatattggcaagttggtagtttactttcaacttttaagcaatatatggacatatccacatatatcagttccatattactagc

SEQ ID NO: 2184 - DNA, 200 bp, Conyza canadensis
gctagtaatatggaactgatatatgtggatatgtccatatattgcttaaaagttgaaagtaaactaccaacttgccaatatcataaaatatgtcaatacctaaaaaatatatactgagagatagattggactaattagtctagggacaaagagaaggctgaaccactgaaccatcaaaagttgttatcattgggtaagtt

SEQ ID NO: 2185 - DNA, 200 bp, Conyza canadensis
catatatcagttccatattactagcatgtatcctattctgggttagtatgctacaaaaagggtttacatgtcaaatgcagaattgttcaaagaaaacgagttgttagacctaataagtcaaagtaatgcttactctacactttgcttactgtttggcagtggcaccatgtcagaagctcaaagaatgcttctaagtggaa

SEQ ID NO: 2186 - DNA, 200 bp, Conyza canadensis
ttccacttagaagcattctttgagcttctgacatggtgccactgccaaacagtaagcaaagtgtagagtaagcattactttgacttattaggtctaacaactcgttttctttgaacaattctgcatttgacatgtaaaccctttttgtagcatactaacccagaataggatacatgctagtaatatggaactgatatatg

SEQ ID NO: 2187 - DNA, 200 bp, Conyza canadensis
gctcaaagaatgcttctaagtggaagtttcaattattatggtaatggcattgtaaatggggcgatttcactgaggtcttctgctagtagatctgcaattgatgaattttgtaatgcacttggaggcaccaggccaatccaaagtattttaattgcaaataatggaatggcggctgtaaagtttataagaagtgtgaggac

SEQ ID NO: 2188 - DNA, 200 bp, Conyza canadensis
gtcctcacacttcttataaactttacagccgccattccattatttgcaattaaaatactttggattggcctggtgcctccaagtgcattacaaaattcatcaattgcagatctactagcagaagacctcagtgaaatcgccccatttacaatgccattaccataataattgaaacttccacttagaagcattctttgagc

SEQ ID NO: 2189 - DNA, 200 bp, Conyza canadensis
taaagtttataagaagtgtgaggacatggagttatgaaacatttggctcagataaagctattttgctggtagccatggctacaccggaagatatgaggataaatgccgagcatattagaatcgctgatcagtttgttgaagtccctggtggtacaaataataataattatgcgaatgtgcaactcattgtagaggtatgt

SEQ ID NO: 2190 - DNA, 200 bp, Conyza canadensis
acatacctctacaatgagttgcacattcgcataattattattatttgtaccaccagggacttcaacaaactgatcagcgattctaatatgctcggcatttatcctcatatcttccggtgtagccatggctaccagcaaaatagctttatctgagccaaatgtttcataactccatgtcctcacacttcttataaacttta

SEQ ID NO: 2191 - DNA, 200 bp, Conyza canadensis
tgtgcaactcattgtagaggtatgtagcttatatacgtggatcctacatcatgatttataagctttaaaatgatctattttatgaaacattgtgcatttaatgatgcctgaaaagattatgtttccaagacttattttgcttaacttgttggatcaaaatgttgatctgcttccatgaatatagtaattcgaatatgttg

SEQ ID NO: 2192 - DNA, 200 bp, Conyza canadensis
caacatattcgaattactatattcatggaagcagatcaacattttgatccaacaagttaagcaaaataagtcttggaaacataatcttttcaggcatcattaaatgcacaatgtttcataaaatagatcattttaaagcttataaatcatgatgtaggatccacgtatataagctacatacctctacaatgagttgcaca

SEQ ID NO: 2193 - DNA, 200 bp, Conyza canadensis
tgaatatagtaattcgaatatgttggtttaatcttcactttcaaaaaaaaaaaaaaatacttctttttatgttagcatttgagtttgaatctcaagagaacttatttcacttttgaaatcgatatggatgtgttgaacatgtaattgataatcagcaacattttaaaatttattagaaaatgacgagggatgcctcttca

SEQ ID NO: 2194 - DNA, 200 bp, Conyza canadensis
tgaagaggcatccctcgtcattttctaataaattttaaaatgttgctgattatcaattacatgttcaacacatccatatcgatttcaaaagtgaaataagttctcttgagattcaaactcaaatgctaacataaaaagaagtatttttttttttttttgaaagtgaagattaaaccaacatattcgaattactatattca

SEQ ID NO: 2195 - DNA, 200 bp, Conyza canadensis
gaaaatgacgagggatgcctcttcaggctacgcggcgagcctttggctctaatgtaagcggcctaaccggtatacccgggtctcttctgagatctttgggtcaccttaccactagacccccttggagaaggttttaaaaagtattagaaagtatataaatataaaatagaaacgatatgtaaaattttaaaaatatgttt

SEQ ID NO: 2196 - DNA, 200 bp, Conyza canadensis
aaacatatttttaaaattttacatatcgtttctattttatatttatatactttctaatactttttaaaaccttctccaagggggtctagtggtaaggtgacccaaagatctcagaagagacccgggtataccggttaggccgcttacattagagccaaaggctcgccgcgtagcctgaagaggcatccctcgtcattttc

SEQ ID NO: 2197 - DNA, 200 bp, Conyza canadensis
tatgtaaaattttaaaaatatgtttcattgagttatcttacacctgactatttgatattgagcattaatacgagtttgatggaaaatataaaataattaatatttagctatcatcatcaattcctttaaaatggttcatttatgatttatgacttcagactgctgagataacacatgttgatgctgtttggcctggttgg

SEQ ID NO: 2198 - DNA, 200 bp, Conyza canadensis
ccaaccaggccaaacagcatcaacatgtgttatctcagcagtctgaagtcataaatcataaatgaaccattttaaaggaattgatgatgatagctaaatattaattattttatattttccatcaaactcgtattaatgctcaatatcaaatagtcaggtgtaagataactcaatgaaacatatttttaaaattttacata

SEQ ID NO: 2199 - DNA, 200 bp, Conyza canadensis
tgttgatgctgtttggcctggttggggccatgcatccgaaatccctgagctgcctgatgcattggaagcaaaaggtattgtatttcttgggccaccagcttcctccatggcagctttaggtgataaaattggttcttctttgattgcacaagctgctgatgtaccgacacttccttggagcggttctcatgtaagatttt

SEQ ID NO: 2200 - DNA, 200 bp, Conyza canadensis
aaaatcttacatgagaaccgctccaaggaagtgtcggtacatcagcagcttgtgcaatcaaagaagaaccaattttatcacctaaagctgccatggaggaagctggtggcccaagaaatacaataccttttgcttccaatgcatcaggcagctcagggatttcggatgcatggccccaaccaggccaaacagcatcaaca

SEQ ID NO: 2201 - DNA, 200 bp, Conyza canadensis
tggagcggttctcatgtaagattttttttactattgtagtctttgtcacatcaacaatgatccttatacttttaactccataaagattgcatcgttctatctcatattctctataatctaaaaaaattctatattcctcttatttgtgaaaagtctgaacttcataacaaaatcacatcttgtacctcttatatattaaa

SEQ ID NO: 2202 - DNA, 200 bp, Conyza canadensis
tttaatatataagaggtacaagatgtgattttgttatgaagttcagacttttcacaaataagaggaatatagaatttttttagattatagagaatatgagatagaacgatgcaatctttatggagttaaaagtataaggatcattgttgatgtgacaaagactacaatagtaaaaaaaatcttacatgagaaccgctcca

SEQ ID NO: 2203 - DNA, 200 bp, Conyza canadensis
catcttgtacctcttatatattaaactgcatctttatgcctctaatttattggaaacaagatctttaaatcctttaaaggttgcatctttatacctcttattctgtagaaattacatttcataccacttgttctttgcaatttcgcatagatattaatgcctactctttaaaagatacttttctacttctttacctctat

SEQ ID NO: 2204 - DNA, 200 bp, Conyza canadensis
atagaggtaaagaagtagaaaagtatcttttaaagagtaggcattaatatctatgcgaaattgcaaagaacaagtggtatgaaatgtaatttctacagaataagaggtataaagatgcaacctttaaaggatttaaagatcttgtttccaataaattagaggcataaagatgcagtttaatatataagaggtacaagatg

SEQ ID NO: 2205 - DNA, 200 bp, Conyza canadensis
tacttttctacttctttacctctataatcacatctttgtacctttcacctctccagtcttcttactctctacagtcacatttttaggtaaaaattcctgtggatagctgtttggacacactcccggatgatgtatatagaaaagcgtgtgtgcatacaacagaagaagcaattgctagttgtcaagttgttggttatcca

SEQ ID NO: 2206 - DNA, 200 bp, Conyza canadensis
tggataaccaacaacttgacaactagcaattgcttcttctgttgtatgcacacacgcttttctatatacatcatccgggagtgtgtccaaacagctatccacaggaatttttacctaaaaatgtgactgtagagagtaagaagactggagaggtgaaaggtacaaagatgtgattatagaggtaaagaagtagaaaagta

SEQ ID NO: 2207 - DNA, 200 bp, Conyza canadensis
tagttgtcaagttgttggttatccagcaatgattaaggcatcatggggtggaggtggcaaaggcataagaaaggtttgattctttacaattgggaaattatttcttctcctcaaagtatacggcaaacttttaaaaccaattacctattgaaactttaggtgcataatgacgaagaagtcaaggcactttttaagcaagt

SEQ ID NO: 2208 - DNA, 200 bp, Conyza canadensis
acttgcttaaaaagtgccttgacttcttcgtcattatgcacctaaagtttcaataggtaattggttttaaaagtttgccgtatactttgaggagaagaaataatttcccaattgtaaagaatcaaacctttcttatgcctttgccacctccaccccatgatgccttaatcattgctggataaccaacaacttgacaacta

SEQ ID NO: 2209 - DNA, 200 bp, Conyza canadensis
aagtcaaggcactttttaagcaagttcagggtgaagtgcctggttcccctattttcattatgaaagttgcttctcaggtaggacaatgttgtaattgttattattttcccaatttcaactcaaaacccattatcattataataatatgttgatttcttgtatatacagagccgacatctagaagtgcagctactatgcga

SEQ ID NO: 2210 - DNA, 200 bp, Conyza canadensis
tcgcatagtagctgcacttctagatgtcggctctgtatatacaagaaatcaacatattattataatgataatgggttttgagttgaaattgggaaaataataacaattacaacattgtcctacctgagaagcaactttcataatgaaaataggggaaccaggcacttcaccctgaacttgcttaaaaagtgccttgactt

SEQ ID NO: 2211 - DNA, 200 bp, Conyza canadensis
atctagaagtgcagctactatgcgatcaacatgggaatgtagcagctttgcatagtcgtgattgcagtgttcaaaggcgacatcaaaaggtaagttcatgtttgtcctttttactttctttttatcctgttttgtaactctaattttatttaatacttgatatgtcaagattattgaagaggggccaataaccatagctc

SEQ ID NO: 2212 - DNA, 200 bp, Conyza canadensis
gagctatggttattggcccctcttcaataatcttgacatatcaagtattaaataaaattagagttacaaaacaggataaaaagaaagtaaaaaggacaaacatgaacttaccttttgatgtcgcctttgaacactgcaatcacgactatgcaaagctgctacattcccatgttgatcgcatagtagctgcacttctagat

SEQ ID NO: 2213 - DNA, 200 bp, Conyza canadensis
gaagaggggccaataaccatagctccacatgacacaataaagaagcttgagcaagcggcgagaagattagcaaagtcggttaattatgttggagcagccactgtagagtatttgtatagcatggaaactggagactattactttttggagctcaatccccggttacaggtgcttgcaatttctgttttgtgggtcctagt

SEQ ID NO: 2214 - DNA, 200 bp, Conyza canadensis
actaggacccacaaaacagaaattgcaagcacctgtaaccggggattgagctccaaaaagtaatagtctccagtttccatgctatacaaatactctacagtggctgctccaacataattaaccgactttgctaatcttctcgccgcttgctcaagcttctttattgtgtcatgtggagctatggttattggcccctcttc

SEQ ID NO: 2215 - DNA, 200 bp, Conyza canadensis
caatttctgttttgtgggtcctagttatgtgtcctaagaagtaagatgaaatggtgggctccaagatggttatgatttgttttctgaagctatgtatgtggaacctttctttaggttgagcatccagtcacagagtggatagcggaaatcaatctacctgcagcacaagttgcggttggaatgggcattcctctttggca

SEQ ID NO: 2216 - DNA, 200 bp, Conyza canadensis
tgccaaagaggaatgcccattccaaccgcaacttgtgctgcaggtagattgatttccgctatccactctgtgactggatgctcaacctaaagaaaggttccacatacatagcttcagaaaacaaatcataaccatcttggagcccaccatttcatcttacttcttaggacacataactaggacccacaaaacagaaattg

SEQ ID NO: 2217 - DNA, 200 bp, Conyza canadensis
ttggaatgggcattcctctttggcaaataccaggttagatatcaaaagttcgttttttgttgactatcatagttggtcttttgctacaatgcaaccatcatgtcaactattttcttaattgctctacatgtcttgttggcttagaaataagacgattttatggaatggacaatagtggaggatacgatgcttggaggaga

SEQ ID NO: 2218 - DNA, 200 bp, Conyza canadensis
tctcctccaagcatcgtatcctccactattgtccattccataaaatcgtcttatttctaagccaacaagacatgtagagcaattaagaaaatagttgacatgatggttgcattgtagcaaaagaccaactatgatagtcaacaaaaaacgaacttttgatatctaacctggtatttgccaaagaggaatgcccattccaa

SEQ ID NO: 2219 - DNA, 200 bp, Conyza canadensis
tggaggatacgatgcttggaggagaacatctgctcttgcaactccatttgactttgacaaggcagagtctatcagcccaaaaggtcattgtattgctgtacgtgtaacaagtgaggacccagatgatggatttaagcccactagtggaaaagttcaggtttggaagcagactaacatataccatatacccctacaaatat

SEQ ID NO: 2220 - DNA, 200 bp, Conyza canadensis
atatttgtaggggtatatggtatatgttagtctgcttccaaacctgaacttttccactagtgggcttaaatccatcatctgggtcctcacttgttacacgtacagcaatacaatgaccttttgggctgatagactctgccttgtcaaagtcaaatggagttgcaagagcagatgttctcctccaagcatcgtatcctcca

SEQ ID NO: 2221 - DNA, 200 bp, Conyza canadensis
atataccatatacccctacaaatataatatatatccttttttttttttttttaccatattgatcgaattccacttttaggagctaagttttaaaagcaagccaaatgtctgggcatacttttctgtcaaggtacgctgggttcaaacctttttttttttttttgaacttccaattgacatattctaaaatgtttgaacat

SEQ ID NO: 2222 - DNA, 200 bp, Conyza canadensis
atgttcaaacattttagaatatgtcaattggaagttcaaaaaaaaaaaaaaaggtttgaacccagcgtaccttgacagaaaagtatgcccagacatttggcttgcttttaaaacttagctcctaaaagtggaattcgatcaatatggtaaaaaaaaaaaaaaaaggatatatattatatttgtaggggtatatggtatat

SEQ ID NO: 2223 - DNA, 200 bp, Conyza canadensis
gacatattctaaaatgtttgaacattgcagtccggaggaggcattcatgaattctcagattctcaatttggtaaagacgactggatcttgtttggttgaaatatcttgaatactcacttattggtgtagttcaagtttacattcttggtcaaaacgttcatgttctcattttaattctgtatctatcttaggccacgttt

SEQ ID NO: 2224 - DNA, 200 bp, Conyza canadensis
aaacgtggcctaagatagatacagaattaaaatgagaacatgaacgttttgaccaagaatgtaaacttgaactacaccaataagtgagtattcaagatatttcaaccaaacaagatccagtcgtctttaccaaattgagaatctgagaattcatgaatgcctcctccggactgcaatgttcaaacattttagaatatgtc

SEQ ID NO: 2225 - DNA, 200 bp, Conyza canadensis
tctgtatctatcttaggccacgtttttgcatttggcgagtcaagacctttggctattgcaaatatggttcttgggctgaaggaaattcaaattcgtggcgagatccgtacgaatgttgattatacaattgatctgttacatgtgagcattttggggtttcacagctaacaaatttcttattttgtttaccataatgagtt

SEQ ID NO: 2226 - DNA, 200 bp, Conyza canadensis
aactcattatggtaaacaaaataagaaatttgttagctgtgaaaccccaaaatgctcacatgtaacagatcaattgtataatcaacattcgtacggatctcgccacgaatttgaatttccttcagcccaagaaccatatttgcaatagccaaaggtcttgactcgccaaatgcaaaaacgtggcctaagatagatacaga

SEQ ID NO: 2227 - DNA, 200 bp, Conyza canadensis
cttattttgtttaccataatgagttacttcatggcgatataaggggtgagccatggagcaagtgccatgtatcttaacagataaattgttatgttcatgtttggcgagtacttacacatttgagaatgtcgagaatttgattatatttcaccaaacgttcttattgcttcacctaaaatgtgaacgttttcttacatgct

SEQ ID NO: 2228 - DNA, 200 bp, Conyza canadensis
agcatgtaagaaaacgttcacattttaggtgaagcaataagaacgtttggtgaaatataatcaaattctcgacattctcaaatgtgtaagtactcgccaaacatgaacataacaatttatctgttaagatacatggcacttgctccatggctcaccccttatatcgccatgaagtaactcattatggtaaacaaaataag

SEQ ID NO: 2229 - DNA, 200 bp, Conyza canadensis
aaatgtgaacgttttcttacatgcttagtttttattcctttttctatacttgtaggctcctgattatagagaaaataaaatacataccggttggttagatagccgaattgctatgagggttagagcagaaaggcccccttggtatctttcagtagttgggggagcactttatgtaagtacaaaatacctctttctttcta

SEQ ID NO: 2230 - DNA, 200 bp, Conyza canadensis
tagaaagaaagaggtattttgtacttacataaagtgctcccccaactactgaaagataccaagggggcctttctgctctaaccctcatagcaattcggctatctaaccaaccggtatgtattttattttctctataatcaggagcctacaagtatagaaaaaggaataaaaactaagcatgtaagaaaacgttcacattt

SEQ ID NO: 2231 - DNA, 200 bp, Conyza canadensis
agtacaaaatacctctttctttctatattcgtcatttttaaagtacttttacttaccattgatgtttgttaacttcagaaagctgctgctagaagtgcagccatggtctcggactatgttggttaccttgaaaagggccaaatccctcctaaggtttgtcagatattttagtatttttttttaatttttaagagttggtt

SEQ ID NO: 2232 - DNA, 200 bp, Conyza canadensis
aaccaactcttaaaaattaaaaaaaaatactaaaatatctgacaaaccttaggagggatttggcccttttcaaggtaaccaacatagtccgagaccatggctgcacttctagcagcagctttctgaagttaacaaacatcaatggtaagtaaaagtactttaaaaatgacgaatatagaaagaaagaggtattttgtact

SEQ ID NO: 2233 - DNA, 200 bp, Conyza canadensis
tttttttaatttttaagagttggttctcgtaatgtttacattgatgatcagtatttgtctgttttcttactttcagcatatatcattggtcaactcacaagtttctttgaatattgagggcagcaaatacacggtaaataacaagataactgcctatcgttattcgttcataaaaatggttgttcttgaagttttctttt

SEQ ID NO: 2234 - DNA, 200 bp, Conyza canadensis
aaaagaaaacttcaagaacaaccatttttatgaacgaataacgataggcagttatcttgttatttaccgtgtatttgctgccctcaatattcaaagaaacttgtgagttgaccaatgatatatgctgaaagtaagaaaacagacaaatactgatcatcaatgtaaacattacgagaaccaactcttaaaaattaaaaaaa

SEQ ID NO: 2235 - DNA, 200 bp, Conyza canadensis
atggttgttcttgaagttttcttttgtgtgttttttttcttctgatttttttctttttatttgttagattgatatggtaaaaagagggccaggaagttacagattgagaatgaatcaatccgagattgaagcagagatacatacactacgtgacggaggcttattgatgcaggtacttaatccatacgctctatttttct

SEQ ID NO: 2236 - DNA, 200 bp, Conyza canadensis
agaaaaatagagcgtatggattaagtacctgcatcaataagcctccgtcacgtagtgtatgtatctctgcttcaatctcggattgattcattctcaatctgtaacttcctggccctctttttaccatatcaatctaacaaataaaaagaaaaaaatcagaagaaaaaaaacacacaaaagaaaacttcaagaacaaccat

SEQ ID NO: 2237 - DNA, 200 bp, Conyza canadensis
cttaatccatacgctctatttttctttctatttggtttattctgtcaaattttctttttatttggtttattctgtcaaaatttctttttatttggtttattccgtagttagtttgtgattaactgattactatattaagtcattggttggtatgtatacatataaaactcgaatataagcattttaatgatgccaaacct

SEQ ID NO: 2238 - DNA, 200 bp, Conyza canadensis
aggtttggcatcattaaaatgcttatattcgagttttatatgtatacataccaaccaatgacttaatatagtaatcagttaatcacaaactaactacggaataaaccaaataaaaagaaattttgacagaataaaccaaataaaaagaaaatttgacagaataaaccaaatagaaagaaaaatagagcgtatggattaag

SEQ ID NO: 2239 - DNA, 200 bp, Conyza canadensis
taagcattttaatgatgccaaacctatatgtagttttactctttaggatttcatgatatacctaggaaatccctcgtgtctttgtggcagctagcaagttgaagattaataatatcaataaagaaattcagagaatttaatgcagcatgttctaagggagtgttcggggatgcattctgaaaataattatgtgatattta

SEQ ID NO: 2240 - DNA, 200 bp, Conyza canadensis
taaatatcacataattattttcagaatgcatccccgaacactcccttagaacatgctgcattaaattctctgaatttctttattgatattattaatcttcaacttgctagctgccacaaagacacgagggatttcctaggtatatcatgaaatcctaaagagtaaaactacatataggtttggcatcattaaaatgctta

SEQ ID NO: 2241 - DNA, 200 bp, Conyza canadensis
tctgaaaataattatgtgatatttagtaaaattgcaattaaacgtggtgcaagaaatagtgtttggatatgcttctgctataaagttctggcaatcgctgtattgagtgtttgacggattatgtctatttaagaaggtggtagataaactaaaagtatacatggttagtggtgctgtaagcatttgccatcaaaaagtag

SEQ ID NO: 2242 - DNA, 200 bp, Conyza canadensis
ctactttttgatggcaaatgcttacagcaccactaaccatgtatacttttagtttatctaccaccttcttaaatagacataatccgtcaaacactcaatacagcgattgccagaactttatagcagaagcatatccaaacactatttcttgcaccacgtttaattgcaattttactaaatatcacataattattttcaga

SEQ ID NO: 2243 - DNA, 200 bp, Conyza canadensis
gtaagcatttgccatcaaaaagtaggtagataaaggaagagtgctataagtagttttatgctactttttggttatcgagttcgttgcagctagtatcaaactaattctttaactatcgtagctgtaataggtcaccctgaacatttcaatttattgcaaccttaagttacatcatttgataatcatgttcaagacacatt

SEQ ID NO: 2244 - DNA, 200 bp, Conyza canadensis
aatgtgtcttgaacatgattatcaaatgatgtaacttaaggttgcaataaattgaaatgttcagggtgacctattacagctacgatagttaaagaattagtttgatactagctgcaacgaactcgataaccaaaaagtagcataaaactacttatagcactcttcctttatctacctactttttgatggcaaatgcttac

SEQ ID NO: 2245 - DNA, 200 bp, Conyza canadensis
ttgataatcatgttcaagacacattcttattttatactctgatatcatatgatttgtggttggttgattcaatgatgtagttggatgggaatagtcatatattatacgccgaggaagaagctgccggtactcgcttgcttattgatggacggacttgcttgcttcaggtgcgaacaactagttcttttcttgaactttat

SEQ ID NO: 2246 - DNA, 200 bp, Conyza canadensis
ataaagttcaagaaaagaactagttgttcgcacctgaagcaagcaagtccgtccatcaataagcaagcgagtaccggcagcttcttcctcggcgtataatatatgactattcccatccaactacatcattgaatcaaccaaccacaaatcatatgatatcagagtataaaataagaatgtgtcttgaacatgattatcaa

SEQ ID NO: 2247 - DNA, 200 bp, Conyza canadensis
aactagttcttttcttgaactttatttagaggttgccatttcaaccatttatctatgatgggacaatttaaacaatgttttacccttaatggtgtattcaaatgggtcaacagtgacccaaagtacattctcactggagcaaactgcctgtatcatttttttttgtgaggttcattgtttttgaataatattgtgttaat

SEQ ID NO: 2248 - DNA, 200 bp, Conyza canadensis
attaacacaatattattcaaaaacaatgaacctcacaaaaaaaaatgatacaggcagtttgctccagtgagaatgtactttgggtcactgttgacccatttgaatacaccattaagggtaaaacattgtttaaattgtcccatcatagataaatggttgaaatggcaacctctaaataaagttcaagaaaagaactagtt

SEQ ID NO: 2249 - DNA, 200 bp, Conyza canadensis
tgtttttgaataatattgtgttaattttcatatttagtagactaaagtaattatgtaagttgttgtgaacccgttcgatctgctcaggttatactcgaccggttgcaatcctcctaatttgccacctttactattacttactatttgggttacctgtttatagaatgatcatgatccttccaagttgatggctgaaacac

SEQ ID NO: 2250 - DNA, 200 bp, Conyza canadensis
gtgtttcagccatcaacttggaaggatcatgatcattctataaacaggtaacccaaatagtaagtaatagtaaaggtggcaaattaggaggattgcaaccggtcgagtataacctgagcagatcgaacgggttcacaacaacttacataattactttagtctactaaatatgaaaattaacacaatattattcaaaaaca

SEQ ID NO: 2251 - DNA, 200 bp, Conyza canadensis
ccttccaagttgatggctgaaacaccatgcaaacttctaaggtacttggtctcagatgatagccatgttaatgctgacacaccgtatgctgaggttgaagttatgaagatgtgtatgccactcctttcaccggctgctggagttatacaattcaagatgtcagaaggtcaagccatgcaggttagcatgtcactttttcc

SEQ ID NO: 2252 - DNA, 200 bp, Conyza canadensis
ggaaaaagtgacatgctaacctgcatggcttgaccttctgacatcttgaattgtataactccagcagccggtgaaaggagtggcatacacatcttcataacttcaacctcagcatacggtgtgtcagcattaacatggctatcatctgagaccaagtaccttagaagtttgcatggtgtttcagccatcaacttggaagg

SEQ ID NO: 2253 - DNA, 200 bp, Conyza canadensis
tgcaggttagcatgtcactttttccccatttttaagaagtatttacattgttcagtttttccgaacatccaagaataaagctcttggttctatgtttttgccaactacttacagctatttatatttacatgttaataaaatgttctatcgattgacttcttgagtcattgtgcttatcgcaactcaatcttcgttattgt

SEQ ID NO: 2254 - DNA, 200 bp, Conyza canadensis
acaataacgaagattgagttgcgataagcacaatgactcaagaagtcaatcgatagaacattttattaacatgtaaatataaatagctgtaagtagttggcaaaaacatagaaccaagagctttattcttggatgttcggaaaaactgaacaatgtaaatacttcttaaaaatggggaaaaagtgacatgctaacctgca

SEQ ID NO: 2255 - DNA, 200 bp, Conyza canadensis
atcgcaactcaatcttcgttattgtacagtgattttttaaatgtaatactgccaactttttgaataaatcgtatcaaatgtaatctttaagctatataacaaacatatgaatttcgatttccaaataatatctacagttcacaaacaaatgcttgtttcctgtttgttaataccatttttgtcttctctaaatcatacat

SEQ ID NO: 2256 - DNA, 200 bp, Conyza canadensis
atgtatgatttagagaagacaaaaatggtattaacaaacaggaaacaagcatttgtttgtgaactgtagatattatttggaaatcgaaattcatatgtttgttatatagcttaaagattacatttgatacgatttattcaaaaagttggcagtattacatttaaaaaatcactgtacaataacgaagattgagttgcgat

SEQ ID NO: 2257 - DNA, 200 bp, Conyza canadensis
tttttgtcttctctaaatcatacataccaaaaccaaaattgttgatcatttctgatgaatataaatctttgtatatgtaggctggtgagcttatagcaaggctagatcttgacgatccgtcagctgtaagaaaagcagagcctttcaatggaaactttcctcttcttgggcctccaacggccatgtcagacaaagtgcat

SEQ ID NO: 2258 - DNA, 200 bp, Conyza canadensis
atgcactttgtctgacatggccgttggaggcccaagaagaggaaagtttccattgaaaggctctgcttttcttacagctgacggatcgtcaagatctagccttgctataagctcaccagcctacatatacaaagatttatattcatcagaaatgatcaacaattttggttttggtatgtatgatttagagaagacaaaaa

SEQ ID NO: 2259 - DNA, 200 bp, Conyza canadensis
aacggccatgtcagacaaagtgcatcagaagtgtgctgcaactttaaatgctgctcgaatgattctcgcaggctatgatcataacattgatgaagtaacttgtttgccatttactgatttcaaattttctgaaagattattctgttaacagttctgatctttgatcgtaggttgtgcaaaacttgcttcgttgtcttgat

SEQ ID NO: 2260 - DNA, 200 bp, Conyza canadensis
atcaagacaacgaagcaagttttgcacaacctacgatcaaagatcagaactgttaacagaataatctttcagaaaatttgaaatcagtaaatggcaaacaagttacttcatcaatgttatgatcatagcctgcgagaatcattcgagcagcatttaaagttgcagcacacttctgatgcactttgtctgacatggccgtt

SEQ ID NO: 2261 - DNA, 200 bp, Conyza canadensis
gcaaaacttgcttcgttgtcttgatagtcccgagcttcctttccttcagtggcaagaatgctttgcagttctagcaaatcgtctccctaaagatctaagaaacaaggcaaattgatattttacccttttttttttcttttcaagcagttaacattgggattatttttctaaattcaatatgttttgtatattcagttgga

SEQ ID NO: 2262 - DNA, 200 bp, Conyza canadensis
tccaactgaatatacaaaacatattgaatttagaaaaataatcccaatgttaactgcttgaaaagaaaaaaaaaagggtaaaatatcaatttgccttgtttcttagatctttagggagacgatttgctagaactgcaaagcattcttgccactgaaggaaaggaagctcgggactatcaagacaacgaagcaagttttgc

SEQ ID NO: 2263 - DNA, 200 bp, Conyza canadensis
aatatgttttgtatattcagttggaatccaagtttaaggagtacgaaggaatttccacacaacaaactattgactttcctgctagagttctacgggtcattcttgaagttagttgtgatcagtagttttctttataagtcctttctttgatttaaagacataatttagttatatgttacctttgtaatgttttcgttcag

SEQ ID NO: 2264 - DNA, 200 bp, Conyza canadensis
ctgaacgaaaacattacaaaggtaacatataactaaattatgtctttaaatcaaagaaaggacttataaagaaaactactgatcacaactaacttcaagaatgacccgtagaactctagcaggaaagtcaatagtttgttgtgtggaaattccttcgtactccttaaacttggattccaactgaatatacaaaacatatt

SEQ ID NO: 2265 - DNA, 200 bp, Conyza canadensis
ttacctttgtaatgttttcgttcagacccatcttggatcttgctcagaaaaagaaaagggagcccaagaaaggctcgttgagccattaatgggtcttgtaaagtcatatgaagggggaagagaaagtcatgcacgtgggatcgttcatgctctatttgatgaatatttatctgttgaagagttgttcagcgacaacattc

SEQ ID NO: 2266 - DNA, 200 bp, Conyza canadensis
gaatgttgtcgctgaacaactcttcaacagataaatattcatcaaatagagcatgaacgatcccacgtgcatgactttctcttcccccttcatatgactttacaagacccattaatggctcaacgagcctttcttgggctcccttttctttttctgagcaagatccaagatgggtctgaacgaaaacattacaaaggtaa

SEQ ID NO: 2267 - DNA, 200 bp, Conyza canadensis
gaagagttgttcagcgacaacattcaggtgcgtttgttaggatcgccgatccagtattttggattttcgatagggcatgcacttgcattaccatagtcagtttatattttatttcatcttgttacacgacaacaaagtaccttttttcaaagtataaaactgcacaggttatgtgctcccaaagggttttttaatacttt

SEQ ID NO: 2268 - DNA, 200 bp, Conyza canadensis
aaagtattaaaaaaccctttgggagcacataacctgtgcagttttatactttgaaaaaaggtactttgttgtcgtgtaacaagatgaaataaaatataaactgactatggtaatgcaagtgcatgccctatcgaaaatccaaaatactggatcggcgatcctaacaaacgcacctgaatgttgtcgctgaacaactcttc

SEQ ID NO: 2269 - DNA, 200 bp, Conyza canadensis
ctcccaaagggttttttaatactttgatctatgtggaaatggtataagagttttaatcattttgacattaatgtctggataaatttgttacgggttaaaccaatcaatctaagccaaaccaaaagttacctgcaaaagctattacctaacccacccattttgccacctctgttggttttctttaggtctactaatggtta

SEQ ID NO: 2270 - DNA, 200 bp, Conyza canadensis
taaccattagtagacctaaagaaaaccaacagaggtggcaaaatgggtgggttaggtaatagcttttgcaggtaacttttggtttggcttagattgattggtttaacccgtaacaaatttatccagacattaatgtcaaaatgattaaaactcttataccatttccacatagatcaaagtattaaaaaaccctttgggag

SEQ ID NO: 2271 - DNA, 200 bp, Conyza canadensis
ttttctttaggtctactaatggttatcgagtaaattatattataacataagtagtaaaccaaaatcctgtaccttttaggctgatgtaatcgaacgtcttcgacaactatacaagaaagatctcttgaggattgtcgacattgtcctttcccatcaggtacacatgttttttggtttttgttctcccctttaatgtgtat

SEQ ID NO: 2272 - DNA, 200 bp, Conyza canadensis
atacacattaaaggggagaacaaaaaccaaaaaacatgtgtacctgatgggaaaggacaatgtcgacaatcctcaagagatctttcttgtatagttgtcgaagacgttcgattacatcagcctaaaaggtacaggattttggtttactacttatgttataatataatttactcgataaccattagtagacctaaagaaaa

SEQ ID NO: 2273 - DNA, 200 bp, Conyza canadensis
ttttgttctcccctttaatgtgtattttataccgatcattaatatatgtccatgcagggtgttaggagtaaaaacaaattgatactacggctgatggagcatttggtttaccccaatccggctgcgtatagggagaaactgatacgattttctcaacttaaccacacaagttattctgaggtcatcatcgtcatatatat

SEQ ID NO: 2274 - DNA, 200 bp, Conyza canadensis
atatatatgacgatgatgacctcagaataacttgtgtggttaagttgagaaaatcgtatcagtttctccctatacgcagccggattggggtaaaccaaatgctccatcagccgtagtatcaatttgtttttactcctaacaccctgcatggacatatattaatgatcggtataaaatacacattaaaggggagaacaaaa

SEQ ID NO: 2275 - DNA, 200 bp, Conyza canadensis
ctgaggtcatcatcgtcatatatatacactgttacaattttgatcatctcaatcacttttctgttagtactgagtttatgttaattgattattattaatagttagcactgaaggcaagtcaacttttagaacaaactaaactaagtgaacttcgttcaagcattgcgcgaagtctttctgaattagagatgtttactgaa

SEQ ID NO: 2276 - DNA, 200 bp, Conyza canadensis
ttcagtaaacatctctaattcagaaagacttcgcgcaatgcttgaacgaagttcacttagtttagtttgttctaaaagttgacttgccttcagtgctaactattaataataatcaattaacataaactcagtactaacagaaaagtgattgagatgatcaaaattgtaacagtgtatatatatgacgatgatgacctcag

SEQ ID NO: 2277 - DNA, 200 bp, Conyza canadensis
ttctgaattagagatgtttactgaagaaggtgaaaatatggatacccctaagaggaagagtgccattaatgaaagaatggaggatattgtgagtgctccattggcagttgaagatgcccttgttggtctttttgaccatagcgatcacacccttcaaaggcgtgttgttgagacctatgttcgaagattatatcaggttt

SEQ ID NO: 2278 - DNA, 200 bp, Conyza canadensis
aaacctgatataatcttcgaacataggtctcaacaacacgcctttgaagggtgtgatcgctatggtcaaaaagaccaacaagggcatcttcaactgccaatggagcactcacaatatcctccattctttcattaatggcactcttcctcttaggggtatccatattttcaccttcttcagtaaacatctctaattcagaa

SEQ ID NO: 2279 - DNA, 200 bp, Conyza canadensis
tatgttcgaagattatatcaggtttttacctttcatttctgcatcaacagagttgtcaatttgttgtcatagaaaattgaaggtgtttgatcagattgttttaaataaaatgtggtttaatatatgcatacatctttaaaaaaagaaacgacatgtatttattggtaaaaaactaaaacatcaaatcaagtgtggatttt

SEQ ID NO: 2280 - DNA, 200 bp, Conyza canadensis
aaaatccacacttgatttgatgttttagttttttaccaataaatacatgtcgtttctttttttaaagatgtatgcatatattaaaccacattttatttaaaacaatctgatcaaacaccttcaattttctatgacaacaaattgacaactctgttgatgcagaaatgaaaggtaaaaacctgatataatcttcgaacata

SEQ ID NO: 2281 - DNA, 200 bp, Conyza canadensis
aaacatcaaatcaagtgtggattttatactgttttttacaaaactttgtaaactgattatatgttgtttacttgaacagataaatgttttaaactattaagaatatttaaaagatggaataagaataaatttaaagtcatttctgagttgtggcccttgagaatagctgttcatgtagttagtagacctatttgactttt

SEQ ID NO: 2282 - DNA, 200 bp, Conyza canadensis
aaaagtcaaataggtctactaactacatgaacagctattctcaagggccacaactcagaaatgactttaaatttattcttattccatcttttaaatattcttaatagtttaaaacatttatctgttcaagtaaacaacatataatcagtttacaaagttttgtaaaaaacagtataaaatccacacttgatttgatgttt

SEQ ID NO: 2283 - DNA, 200 bp, Conyza canadensis
tagttagtagacctatttgacttttttctaaaatgtatactacactgtttattaatgcctactcaaatgaatcgggttgtctaaaataaaacatcacttataacaacaataaaagaagcaaagcagtcattttagtttgcacttttgcaattctcttggtaggaagaaatctaatatgattttaactgaccatgcttctc

SEQ ID NO: 2284 - DNA, 200 bp, Conyza canadensis
gagaagcatggtcagttaaaatcatattagatttcttcctaccaagagaattgcaaaagtgcaaactaaaatgactgctttgcttcttttattgttgttataagtgatgttttattttagacaacccgattcatttgagtaggcattaataaacagtgtagtatacattttagaaaaaagtcaaataggtctactaacta

SEQ ID NO: 2285 - DNA, 200 bp, Conyza canadensis
atgattttaactgaccatgcttctcatatctgtatcagccatatctcgtgaaggggagtgttagaatgcagtggcacagatccggactcatcgctacatggcaatttatagaaggactcattggagaagttaatgtgcctgactatgaacagaatgaagctcccttggaagacaagaaatggggagctatggttattatt

SEQ ID NO: 2286 - DNA, 200 bp, Conyza canadensis
aataataaccatagctccccatttcttgtcttccaagggagcttcattctgttcatagtcaggcacattaacttctccaatgagtccttctataaattgccatgtagcgatgagtccggatctgtgccactgcattctaacactccccttcacgagatatggctgatacagatatgagaagcatggtcagttaaaatcat

SEQ ID NO: 2287 - DNA, 200 bp, Conyza canadensis
gaaatggggagctatggttattattaaatctcttcaatttttgcctgatgtcataagtgcatctcttaaagaaacgagtcataaccttcccagaacaagtcagaatgggtttgctggtcatagtaaccatggtaatatgatgcacattgctttggccggcataaataaccagatgagtttgcttcaagacaggtatgtga

SEQ ID NO: 2288 - DNA, 200 bp, Conyza canadensis
tcacatacctgtcttgaagcaaactcatctggttatttatgccggccaaagcaatgtgcatcatattaccatggttactatgaccagcaaacccattctgacttgttctgggaaggttatgactcgtttctttaagagatgcacttatgacatcaggcaaaaattgaagagatttaataataaccatagctccccatttc

SEQ ID NO: 2289 - DNA, 200 bp, Conyza canadensis
agtttgcttcaagacaggtatgtgatgataatgttacatgaaaagataccatcaaacctgctttatgatctttgtgtcatgctcaagaaacaaaataactggataaatataaaaactgagacccatcatcattcgatgatgcatgccatgttaacagtcggtagatttgatggcttattcattagctggtgacatatatt

SEQ ID NO: 2290 - DNA, 200 bp, Conyza canadensis
aatatatgtcaccagctaatgaataagccatcaaatctaccgactgttaacatggcatgcatcatcgaatgatgatgggtctcagtttttatatttatccagttattttgtttcttgagcatgacacaaagatcataaagcaggtttgatggtatcttttcatgtaacattatcatcacatacctgtcttgaagcaaact

SEQ ID NO: 2291 - DNA, 200 bp, Conyza canadensis
tattcattagctggtgacatatatttgccctgttgatgttatgttcacttgttatgtgatgaactgtagtggtgatgaggatcaggctcaagagagagtcaacaggttagcaaaaatactcaaagataaagaagtaagctcgagtcttaaaaacgcagggtatggagtgatcagttgtataatacaaagagatgaaggga

SEQ ID NO: 2292 - DNA, 200 bp, Conyza canadensis
tcccttcatctctttgtattatacaactgatcactccataccctgcgtttttaagactcgagcttacttctttatctttgagtatttttgctaacctgttgactctctcttgagcctgatcctcatcaccactacagttcatcacataacaagtgaacataacatcaacagggcaaatatatgtcaccagctaatgaata

SEQ ID NO: 2293 - DNA, 200 bp, Conyza canadensis
tgtataatacaaagagatgaagggagaggccccatgagacactcatttcactggtcagaagagaatcattattatattgaagagccattattgcgtcacttggagcctccattatcgacatatcttgaactggtttgtgctcaaaagacccttcataatttttcaattcattaataatattataatactaatgaagttgt

SEQ ID NO: 2294 - DNA, 200 bp, Conyza canadensis
acaacttcattagtattataatattattaatgaattgaaaaattatgaagggtcttttgagcacaaaccagttcaagatatgtcgataatggaggctccaagtgacgcaataatggctcttcaatataataatgattctcttctgaccagtgaaatgagtgtctcatggggcctctcccttcatctctttgtattataca

SEQ ID NO: 2295 - DNA, 200 bp, Conyza canadensis
aatattataatactaatgaagttgtaaatgtattgcttatgcaggacaaacttaagggctatgataatataaagtacactccgtcgcgtgaccgtcaatggcacatgtatactgttgatgctaaaccacttccggtacaaagaatgtttcttagaactcttataaggcatccaacaaaggaatggttctcgccctcaggt

SEQ ID NO: 2296 - DNA, 200 bp, Conyza canadensis
acctgagggcgagaaccattcctttgttggatgccttataagagttctaagaaacattctttgtaccggaagtggtttagcatcaacagtatacatgtgccattgacggtcacgcgacggagtgtactttatattatcatagcccttaagtttgtcctgcataagcaatacatttacaacttcattagtattataatatt

SEQ ID NO: 2297 - DNA, 200 bp, Conyza canadensis
aaaggaatggttctcgccctcaggttaccaaggttcagaagatgagggcccacggtctcagttaaatctcccttttacatcaaggagcatcttgagatcattagtgacggctatggaggagttggaacttcatgttcataatgctactgtcaagtctgaccatgctcatatgtacctatatgtattgaaggagcaacaaa

SEQ ID NO: 2298 - DNA, 200 bp, Conyza canadensis
tttgttgctccttcaatacatataggtacatatgagcatggtcagacttgacagtagcattatgaacatgaagttccaactcctccatagccgtcactaatgatctcaagatgctccttgatgtaaaagggagatttaactgagaccgtgggccctcatcttctgaaccttggtaacctgagggcgagaaccattccttt

SEQ ID NO: 2299 - DNA, 200 bp, Conyza canadensis
ctatatgtattgaaggagcaacaaattggtgatcttgttccatacacaacgtaagtattcatgtcatcttcatgaatttttttttatcatatgcactcatttaacaatggtaatatgttgtgaacaggagagtggatgtagattctgggacagaagattgcgtggttgagacacttttggtaaggctggctcgtgaaatc

SEQ ID NO: 2300 - DNA, 200 bp, Conyza canadensis
gatttcacgagccagccttaccaaaagtgtctcaaccacgcaatcttctgtcccagaatctacatccactctcctgttcacaacatattaccattgttaaatgagtgcatatgataaaaaaaaattcatgaagatgacatgaatacttacgttgtgtatggaacaagatcaccaatttgttgctccttcaatacatatag

SEQ ID NO: 2301 - DNA, 200 bp, Conyza canadensis
tttggtaaggctggctcgtgaaatccattcaatggttggtgtaaagatgcaccggttgggagtttttgagtgggaggtgaagctttgcatggcatcatcgggtcaagccaacggtgcgtggagggttgtggtcacaaatgtgactggtcatacctgcgttgtgcatgtaagtcattagataggattatagacatttcagc

SEQ ID NO: 2302 - DNA, 200 bp, Conyza canadensis
gctgaaatgtctataatcctatctaatgacttacatgcacaacgcaggtatgaccagtcacatttgtgaccacaaccctccacgcaccgttggcttgacccgatgatgccatgcaaagcttcacctcccactcaaaaactcccaaccggtgcatctttacaccaaccattgaatggatttcacgagccagccttaccaaa

SEQ ID NO: 2303 - DNA, 200 bp, Conyza canadensis
tagataggattatagacatttcagcaatacccctcaaacatgcttttacctaaagtcaattgctgcaattttgatttaggtatatcgtgaactggaagatactggtttgcacaaggtgtatcatgctacctctacattgggtcctttgcatggcgtacctgtgaatacaccctttcagcctttaggattacttgatcaga

SEQ ID NO: 2304 - DNA, 200 bp, Conyza canadensis
tctgatcaagtaatcctaaaggctgaaagggtgtattcacaggtacgccatgcaaaggacccaatgtagaggtagcatgatacaccttgtgcaaaccagtatcttccagttcacgatatacctaaatcaaaattgcagcaattgactttaggtaaaagcatgtttgaggggtattgctgaaatgtctataatcctatcta

SEQ ID NO: 2305 - DNA, 200 bp, Conyza canadensis
cagcctttaggattacttgatcagaagcgtcttttggcaaggaaaagcaatactacgtactgctacgactttgcactggtataactatcattttgctctttcaatgcttgatggtcacctaaatttgattgtacagaaacacttattaccatatctatatttccaggcatttgaagcagctcttgagaatatctgggcgt

SEQ ID NO: 2306 - DNA, 200 bp, Conyza canadensis
acgcccagatattctcaagagctgcttcaaatgcctggaaatatagatatggtaataagtgtttctgtacaatcaaatttaggtgaccatcaagcattgaaagagcaaaatgatagttataccagtgcaaagtcgtagcagtacgtagtattgcttttccttgccaaaagacgcttctgatcaagtaatcctaaaggctg

SEQ ID NO: 2307 - DNA, 200 bp, Conyza canadensis
gcagctcttgagaatatctgggcgtcgaaagtcgtaagtgatagcaggcctaagggtaaacttgtgaatgtgacggagctcatgtttgctgagccaagtggctcatggggaactccccttgttgcagtaaatcgtgagccagggcaaaacaaggtgggcatggtggcgtggactatggacctctgcactcctgagtttcc

SEQ ID NO: 2308 - DNA, 200 bp, Conyza canadensis
ggaaactcaggagtgcagaggtccatagtccacgccaccatgcccaccttgttttgccctggctcacgatttactgcaacaaggggagttccccatgagccacttggctcagcaaacatgagctccgtcacattcacaagtttacccttaggcctgctatcacttacgactttcgacgcccagatattctcaagagctgc

SEQ ID NO: 2309 - DNA, 200 bp, Conyza canadensis
tggacctctgcactcctgagtttcctgatggaagaacgattttggtagtagcaaacgatgttacgttcaaaaatggatcttttggtcctcttgaggatgccttttttgaggcagttactgatctcgcttgtgccaagaaactgccactaatatacttggcagcaaactcgggggcccgtatcggagcggctgaggaagtc

SEQ ID NO: 2310 - DNA, 200 bp, Conyza canadensis
gacttcctcagccgctccgatacgggcccccgagtttgctgccaagtatattagtggcagtttcttggcacaagcgagatcagtaactgcctcaaaaaaggcatcctcaagaggaccaaaagatccatttttgaacgtaacatcgtttgctactaccaaaatcgttcttccatcaggaaactcaggagtgcagaggtcca

SEQ ID NO: 2311 - DNA, 200 bp, Conyza canadensis
ccgtatcggagcggctgaggaagtcagatcttgctttagaattgggtggtctgatgagtcgactcctgaatcgggattccagtatttgtatcttactcctgaagattatacccacatcaaatcatctgtaatagctcatgaggttcatctatcaaatggcgaaacaagatatgtcatcgatactattgtgggaaaagaag

SEQ ID NO: 2312 - DNA, 200 bp, Conyza canadensis
cttcttttcccacaatagtatcgatgacatatcttgtttcgccatttgatagatgaacctcatgagctattacagatgatttgatgtgggtataatcttcaggagtaagatacaaatactggaatcccgattcaggagtcgactcatcagaccacccaattctaaagcaagatctgacttcctcagccgctccgatacgg

SEQ ID NO: 2313 - DNA, 200 bp, Conyza canadensis
atcgatactattgtgggaaaagaagacggactcggggttgaaaatttgagtggtagcggggcaattgctggtgcctattcgaaagcatataaggaaacgtttacattaacatatgttactggaagaacagttgggataggcgcatatctggcacgtcttgggatgcggtgcatacagcggcttgatcaaccgattatatt

SEQ ID NO: 2314 - DNA, 200 bp, Conyza canadensis
aatataatcggttgatcaagccgctgtatgcaccgcatcccaagacgtgccagatatgcgcctatcccaactgttcttccagtaacatatgttaatgtaaacgtttccttatatgctttcgaataggcaccagcaattgccccgctaccactcaaattttcaaccccgagtccgtcttcttttcccacaatagtatcgat

SEQ ID NO: 2315 - DNA, 200 bp, Conyza canadensis
agcggcttgatcaaccgattatattaacgggtttttctgcactgaacaagcttttgggccgagaggtttatagctcacagatgcaactaggtgggcctaaaattatggctacgaatggtgttgtccatttaacggtgtccgatgatctcgaaggtgtctcagctatcttgaattggttgagctttgttccaccttatgtc

SEQ ID NO: 2316 - DNA, 200 bp, Conyza canadensis
gacataaggtggaacaaagctcaaccaattcaagatagctgagacaccttcgagatcatcggacaccgttaaatggacaacaccattcgtagccataattttaggcccacctagttgcatctgtgagctataaacctctcggcccaaaagcttgttcagtgcagaaaaacccgttaatataatcggttgatcaagccgct

SEQ ID NO: 2317 - DNA, 200 bp, Conyza canadensis
gttgagctttgttccaccttatgtcggtggcccacttcctgttttagcacctgtggatccaccagaaaggcccgttgagtacctccctgaaaactcatgtgatcctcgggcagctatttgtggggtcgtggatagcaacggtgaatgggctggtgggattttcgatagagacagttttgtggagacattggaaggttggg

SEQ ID NO: 2318 - DNA, 200 bp, Conyza canadensis
cccaaccttccaatgtctccacaaaactgtctctatcgaaaatcccaccagcccattcaccgttgctatccacgaccccacaaatagctgcccgaggatcacatgagttttcagggaggtactcaacgggcctttctggtggatccacaggtgctaaaacaggaagtgggccaccgacataaggtggaacaaagctcaac

SEQ ID NO: 2319 - DNA, 200 bp, Conyza canadensis
tttgtggagacattggaaggttgggcgaggacagtcgtaacgggtcgtgccaaacttggcgggatcccagtcgggatcgttgctgttgagacacaaacagtgatgcaagaaatacctgcagatcccgggcagcttgattcacacgaacgtgttgttcctcaagcaggtcaggtctggttcccggattccgccagcaaaac

SEQ ID NO: 2320 - DNA, 200 bp, Conyza canadensis
gttttgctggcggaatccgggaaccagacctgacctgcttgaggaacaacacgttcgtgtgaatcaagctgcccgggatctgcaggtatttcttgcatcactgtttgtgtctcaacagcaacgatcccgactgggatcccgccaagtttggcacgacccgttacgactgtcctcgcccaaccttccaatgtctccacaaa

SEQ ID NO: 2321 - DNA, 200 bp, Conyza canadensis
ggttcccggattccgccagcaaaacagctcaggcattgatggatttcaaccgagaagagctcccacttttcatcatggctaactggcgaggcttttctgcaggtcagcgggatctttttgaagggattttacaagcagggtcaacaattgttgagaatctcagaacatataaccagcctgtttttgtatacatcccgaaa

SEQ ID NO: 2322 - DNA, 200 bp, Conyza canadensis
tttcgggatgtatacaaaaacaggctggttatatgttctgagattctcaacaattgttgaccctgcttgtaaaatcccttcaaaaagatcccgctgacctgcagaaaagcctcgccagttagccatgatgaaaagtgggagctcttctcggttgaaatccatcaatgcctgagctgttttgctggcggaatccgggaacc

SEQ ID NO: 2323 - DNA, 200 bp, Conyza canadensis
gcctgtttttgtatacatcccgaaaactggagaacttcgtggcggtgcatgggtggttgtcgacagtcgaatcaattcagatcatatagaaatgtatgcagaaaccacagcaaaaggaaatgtccttgaacctgaaggtatgattgagattaagttccgaaacaaagaattgatagactgtatgggtcgtctagatccac

SEQ ID NO: 2324 - DNA, 200 bp, Conyza canadensis
gtggatctagacgacccatacagtctatcaattctttgtttcggaacttaatctcaatcataccttcaggttcaaggacatttccttttgctgtggtttctgcatacatttctatatgatctgaattgattcgactgtcgacaaccacccatgcaccgccacgaagttctccagttttcgggatgtatacaaaaacaggc

SEQ ID NO: 2325 - DNA, 200 bp, Conyza canadensis
gactgtatgggtcgtctagatccacagattcgaagccttaaagaaagacttcgagaaacaaagtacgatcaaacgatcgtccaacagataaaatctcgtgaaaaacagcttttaccgatttacactcaaattgctaccaaattcgctgaacttcatgacacatcattgcgaatggctgaaaaaggtgtggtcaaacaagt

SEQ ID NO: 2326 - DNA, 200 bp, Conyza canadensis
acttgtttgaccacacctttttcagccattcgcaatgatgtgtcatgaagttcagcgaatttggtagcaatttgagtgtaaatcggtaaaagctgtttttcacgagattttatctgttggacgatcgtttgatcgtactttgtttctcgaagtctttctttaaggcttcgaatctgtggatctagacgacccatacagtc

SEQ ID NO: 2327 - DNA, 200 bp, Conyza canadensis
ctgaaaaaggtgtggtcaaacaagttgttgactggaaagtatctcggtttttcttttacaaaaggcttcgtcgtaggctcgcagaggcttccttgatcagtagtgctcgtgaagctgctggtgatactctttcctacaagtctgctcatgagttgattaagaaatggtttttggaatcgaaaactgaagatttatggctt

SEQ ID NO: 2328 - DNA, 200 bp, Conyza canadensis
aagccataaatcttcagttttcgattccaaaaaccatttcttaatcaactcatgagcagacttgtaggaaagagtatcaccagcagcttcacgagcactactgatcaaggaagcctctgcgagcctacgacgaagccttttgtaaaagaaaaaccgagatactttccagtcaacaacttgtttgaccacacctttttcag

SEQ ID NO: 2329 - DNA, 200 bp, Conyza canadensis
atcgaaaactgaagatttatggcttagtgatgatgcttttttcacttggaaagacaatctgatgaactataatgacaagttagccaagctacgtactcagaagctcttggatcagttattaaagattggtaattcaccattggatctacaagctttaccacaaggcctcgccgcacttttgcaagaggtgaacaaactct

SEQ ID NO: 2330 - DNA, 200 bp, Conyza canadensis
agagtttgttcacctcttgcaaaagtgcggcgaggccttgtggtaaagcttgtagatccaatggtgaattaccaatctttaataactgatccaagagcttctgagtacgtagcttggctaacttgtcattatagttcatcagattgtctttccaagtgaaaaaagcatcatcactaagccataaatcttcagttttcgat

SEQ ID NO: 2331 - DNA, 200 bp, Conyza canadensis
cttttgcaagaggtgaacaaactctcttttattttcccttagaactatttaatttaattatctatgaatgcgcaaaaacaacagttttatttaaatatttttctttcactatgctgcaggtggatccagtgaccaaaaataaactagtcgaagaactcttgcgcgtaattaagtaggtaattatacacaaagctcatcag

SEQ ID NO: 2332 - DNA, 200 bp, Conyza canadensis
ctgatgagctttgtgtataattacctacttaattacgcgcaagagttcttcgactagtttatttttggtcactggatccacctgcagcatagtgaaagaaaaatatttaaataaaactgttgtttttgcgcattcatagataattaaattaaatagttctaagggaaaataaaagagagtttgttcacctcttgcaaaag

SEQ ID NO: 2333 - DNA, 200 bp, Conyza canadensis
ggtaattatacacaaagctcatcagattctttctttgtttgtcaaagtgagaagccttttgagcagtgtacattataagtaggtgtcataagaaaacaggctcaaaatagtttaaagtatatgaggtttaccatgttcagattgttttatttttcttcataaattgtataataccatcacatttctatcgcattttttat

SEQ ID NO: 2334 - DNA, 200 bp, Conyza canadensis
ataaaaaatgcgatagaaatgtgatggtattatacaatttatgaagaaaaataaaacaatctgaacatggtaaacctcatatactttaaactattttgagcctgttttcttatgacacctacttataatgtacactgctcaaaaggcttctcactttgacaaacaaagaaagaatctgatgagctttgtgtataattacc

SEQ ID NO: 2335 - DNA, 200 bp, Conyza canadensis
atcacatttctatcgcattttttatatatctatatataaatggtcattttttattttattttatttttataaaaggttctctttgaccatctttgtgtttccttttggctcttcttgtccatcttcagttcttctccttccttcgctttcttttcgtctcttgagttatcttttctttatcttctcatcgtgtacggatt

SEQ ID NO: 2336 - DNA, 200 bp, Conyza canadensis
aatccgtacacgatgagaagataaagaaaagataactcaagagacgaaaagaaagcgaaggaaggagaagaactgaagatggacaagaagagccaaaaggaaacacaaagatggtcaaagagaaccttttataaaaataaaataaaataaaaaatgaccatttatatatagatatataaaaaatgcgatagaaatgtgat

SEQ ID NO: 2337 - DNA, 200 bp, Conyza canadensis
tttatcttctcatcgtgtacggattacgttgatatgagcacatatggcaaagttgattcagataactccacaacaaattttcacttgatttttgaatgtttataagcttacaatacatccatgcactcatgttcatctgctaaatgtactagtacataatcaagttaaaaacttcaacccaagaacactattccactaaa

SEQ ID NO: 2338 - DNA, 200 bp, Conyza canadensis
tttagtggaatagtgttcttgggttgaagtttttaacttgattatgtactagtacatttagcagatgaacatgagtgcatggatgtattgtaagcttataaacattcaaaaatcaagtgaaaatttgttgtggagttatctgaatcaactttgccatatgtgctcatatcaacgtaatccgtacacgatgagaagataaa

SEQ ID NO: 2339 - DNA, 200 bp, Conyza canadensis
aacccaagaacactattccactaaaaatttcggcatgatctcatcataaaatctacaatcattgtttattgtcaaccatcaaagacctgtagaatactaatgaacaattgcaacaagtgaacagtttgccccttgttaccgttgaatgaatatttcaaagatcatgatcgagcctcgatcttgaccagcactgaaacatt

SEQ ID NO: 2340 - DNA, 200 bp, Conyza canadensis
aatgtttcagtgctggtcaagatcgaggctcgatcatgatctttgaaatattcattcaacggtaacaaggggcaaactgttcacttgttgcaattgttcattagtattctacaggtctttgatggttgacaataaacaatgattgtagattttatgatgagatcatgccgaaatttttagtggaatagtgttcttgggtt

SEQ ID NO: 2341 - DNA, 200 bp, Conyza canadensis
cgatcttgaccagcactgaaacattataaaaacaacttccattttaaatgtttgtctaatatagggaagtgagagtcaggtagcccacaatgttttagaccccagagctacttgttctggctgtggggttaaatatagttatatagacttatgttaagtgcaggcattacacacttttttgcattatatgtttacgcgca

SEQ ID NO: 2342 - DNA, 200 bp, Conyza canadensis
tgcgcgtaaacatataatgcaaaaaagtgtgtaatgcctgcacttaacataagtctatataactatatttaaccccacagccagaacaagtagctctggggtctaaaacattgtgggctacctgactctcacttccctatattagacaaacatttaaaatggaagttgtttttataatgtttcagtgctggtcaagatcg

SEQ ID NO: 2343 - DNA, 200 bp, Conyza canadensis
tttttgcattatatgtttacgcgcagatatatgtatttgtgaccagttaaaccggtgtgcttctcttttctgtgtaatgagctctgttatgcagtttcgggtttgagtcgctttgtgataattttgtatgtgttactggcccggccagataaatgatcggttgatataggctggttctagtcacactagacgctgattag

SEQ ID NO: 2344 - DNA, 200 bp, Conyza canadensis
ctaatcagcgtctagtgtgactagaaccagcctatatcaaccgatcatttatctggccgggccagtaacacatacaaaattatcacaaagcgactcaaacccgaaactgcataacagagctcattacacagaaaagagaagcacaccggtttaactggtcacaaatacatatatctgcgcgtaaacatataatgcaaaaa

SEQ ID NO: 2345 - DNA, 200 bp, Conyza canadensis
tctagtcacactagacgctgattagtggttaggcttcgatgtataaatcaaagttatagctacattcaaatcattattataattatttctatttcattcaaagtaggaagattatatcatacataaatatgacacacaggatgaatttcataaacttcaattctacttttcattaaaagcttaatttatctagttgcccg

SEQ ID NO: 2346 - DNA, 200 bp, Conyza canadensis
cgggcaactagataaattaagcttttaatgaaaagtagaattgaagtttatgaaattcatcctgtgtgtcatatttatgtatgatataatcttcctactttgaatgaaatagaaataattataataatgatttgaatgtagctataactttgatttatacatcgaagcctaaccactaatcagcgtctagtgtgactaga

SEQ ID NO: 2347 - DNA, 200 bp, Conyza canadensis
aaagcttaatttatctagttgcccggtttcccattcttcttcccgttgccgccaccaggccttttactccaccatggccaccccctccttccccaaccaccaaatggatatccaccccagatacctggccatccaccacctggccaaaatccgccaccaggaaaatatccaccacctggccaataacccccataatacgg

SEQ ID NO: 2348 - DNA, 200 bp, Conyza canadensis
ccgtattatgggggttattggccaggtggtggatattttcctggtggcggattttggccaggtggtggatggccaggtatctggggtggatatccatttggtggttggggaaggagggggtggccatggtggagtaaaaggcctggtggcggcaacgggaagaagaatgggaaaccgggcaactagataaattaagcttt

SEQ ID NO: 2349 - DNA, 200 bp, Conyza canadensis
ctggccaataacccccataatacggatatgatgggtcatagccccctccatatcctttacctcttcctggtccaccgtaccctccatatccatcacccgaatcataacctccccctccaccatatctgccaccatgatcttttccacgtccttcatcataaccaccatcttctccaccatgatcttttccacgtccttca

SEQ ID NO: 2350 - DNA, 200 bp, Conyza canadensis
tgaaggacgtggaaaagatcatggtggagaagatggtggttatgatgaaggacgtggaaaagatcatggtggcagatatggtggagggggaggttatgattcgggtgatggatatggagggtacggtggaccaggaagaggtaaaggatatggagggggctatgacccatcatatccgtattatgggggttattggccag

SEQ ID NO: 2351 - DNA, 200 bp, Conyza canadensis
accatgatcttttccacgtccttcatcgtcgtcccctttgccttcatgatcaccatcttcaccaccatgatcttctccaggttcatcatcatcatggtcatcgccttttcccccttcatcaccatgatctcttcctggtccatcttgtccaccaccttcatgatcaccaccttcatcaccatgatcttgtccaggtccat

SEQ ID NO: 2352 - DNA, 200 bp, Conyza canadensis
atggacctggacaagatcatggtgatgaaggtggtgatcatgaaggtggtggacaagatggaccaggaagagatcatggtgatgaagggggaaaaggcgatgaccatgatgatgatgaacctggagaagatcatggtggtgaagatggtgatcatgaaggcaaaggggacgacgatgaaggacgtggaaaagatcatggt

SEQ ID NO: 2353 - DNA, 200 bp, Digitaria sanguinalis
aatcaactttatgctcaagcgaaagagcttatatttgctgattcagttggagcatggggcactccagtggttttagttgaacgccctccaggcaacaatgatattggcattgttgcttggaacatgaagctgtccacaccagaatttcctaatggccgcgatattatagttgttgcaaatgatgtgacatttaaagctgg

SEQ ID NO: 2354 - DNA, 200 bp, Digitaria sanguinalis
ccagctttaaatgtcacatcatttgcaacaactataatatcgcggccattaggaaattctggtgtggacagcttcatgttccaagcaacaatgccaatatcattgttgcctggagggcgttcaactaaaaccactggagtgccccatgctccaactgaatcagcaaatataagctctttcgcttgagcataaagttgatt

SEQ ID NO: 2355 - DNA, 200 bp, Digitaria sanguinalis
caaatgatgtgacatttaaagctgggtcctttggtccaagagaagatgcgttttttgatgctgttaccaatcttgcttgtgagaggaaacttcctcttatctacctagctgcaactgctggtgccaggcttggtgtagcagaggaaataaaggcatgcttccatgtcggctggtctgatgatgagagccctgaacgtggt

SEQ ID NO: 2356 - DNA, 200 bp, Digitaria sanguinalis
accacgttcagggctctcatcatcagaccagccgacatggaagcatgcctttatttcctctgctacaccaagcctggcaccagcagttgcagctaggtagataagaggaagtttcctctcacaagcaagattggtaacagcatcaaaaaacgcatcttctcttggaccaaaggacccagctttaaatgtcacatcatttg

SEQ ID NO: 2357 - DNA, 200 bp, Digitaria sanguinalis
tgatgatgagagccctgaacgtggttttcactacatctacctaactgaacaagactattcacgtctaagctcttcagttatagctcacgagctgaaactagaaaatggagaaaccagatgggtggttgataccattgttgggaaagaggatgggcttggttgtgagaatctacatggaagtggtgcaattgccagtgcgt

SEQ ID NO: 2358 - DNA, 200 bp, Digitaria sanguinalis
acgcactggcaattgcaccacttccatgtagattctcacaaccaagcccatcctctttcccaacaatggtatcaaccacccatctggtttctccattttctagtttcagctcgtgagctataactgaagagcttagacgtgaatagtcttgttcagttaggtagatgtagtgaaaaccacgttcagggctctcatcatca

SEQ ID NO: 2359 - DNA, 200 bp, Digitaria sanguinalis
ggaagtggtgcaattgccagtgcgtattctaaggcatataaagagaccttcaccctgacatttgtgactggaagagctgttggcattggggcttacctggctcgtttaggtatgaggtgcatacaacgtcttgatcaaccaattattttgactgggttttctgcattgaacaagcttctaggacgggaggtatacagttc

SEQ ID NO: 2360 - DNA, 200 bp, Digitaria sanguinalis
gaactgtatacctcccgtcctagaagcttgttcaatgcagaaaacccagtcaaaataattggttgatcaagacgttgtatgcacctcatacctaaacgagccaggtaagccccaatgccaacagctcttccagtcacaaatgtcagggtgaaggtctctttatatgccttagaatacgcactggcaattgcaccacttcc

SEQ ID NO: 2361 - DNA, 200 bp, Digitaria sanguinalis
ttctaggacgggaggtatacagttctcatatgcaattgggtggccccaaaatcatggctacaaatggtgttgtccaccagaccgtgtcagatgatcttgaaggtatttctgctatcctaaaatggctcagctatgttcctccctatgttggtggtcctcttcctattatgaaacccctggacccaccagaaagacctgta

SEQ ID NO: 2362 - DNA, 200 bp, Digitaria sanguinalis
tacaggtctttctggtgggtccaggggtttcataataggaagaggaccaccaacatagggaggaacatagctgagccattttaggatagcagaaataccttcaagatcatctgacacggtctggtggacaacaccatttgtagccatgattttggggccacccaattgcatatgagaactgtatacctcccgtcctagaa

SEQ ID NO: 2363 - DNA, 200 bp, Digitaria sanguinalis
cctggacccaccagaaagacctgtaacatacttccctgagaatgcttgtgatgctcgtgccgccatatgtggtgttcaggacggtgaaggcaagtggttgggtggtatgtttgacaaggaaagcttcgtggaaacattggaaggctgggcaaaaactgttatcaccgggagagcaaaacttggtggaataccagttggtg

SEQ ID NO: 2364 - DNA, 200 bp, Digitaria sanguinalis
caccaactggtattccaccaagttttgctctcccggtgataacagtttttgcccagccttccaatgtttccacgaagctttccttgtcaaacataccacccaaccacttgccttcaccgtcctgaacaccacatatggcggcacgagcatcacaagcattctcagggaagtatgttacaggtctttctggtgggtccagg

SEQ ID NO: 2365 - DNA, 200 bp, Digitaria sanguinalis
aaacttggtggaataccagttggtgtcatagctgtggaaacccagacagtgatgcaagtcatccctgctgatccagggcagcttgattccgctgagcgtgtagtccctcaagcaggacaggtgtggttccctgattctgccaccaaaacggctcaggcattgctggatttcaaccgtgaggagcttccacttttcatcct

SEQ ID NO: 2366 - DNA, 200 bp, Digitaria sanguinalis
aggatgaaaagtggaagctcctcacggttgaaatccagcaatgcctgagccgttttggtggcagaatcagggaaccacacctgtcctgcttgagggactacacgctcagcggaatcaagctgccctggatcagcagggatgacttgcatcactgtctgggtttccacagctatgacaccaactggtattccaccaagttt

SEQ ID NO: 2367 - DNA, 200 bp, Digitaria sanguinalis
gtgaggagcttccacttttcatccttgcaaattggagaggtttctctggtgggcaaagggatttgtttgaagggatacttcaggctggttcaacaattgttgagaatctgaggacatacaagcagcctgctttcgtatatatcccaatgggtggagagctgcggggaggggcctgggttgtggtggacagcaagatcaat

SEQ ID NO: 2368 - DNA, 200 bp, Digitaria sanguinalis
attgatcttgctgtccaccacaacccaggcccctccccgcagctctccacccattgggatatatacgaaagcaggctgcttgtatgtcctcagattctcaacaattgttgaaccagcctgaagtatcccttcaaacaaatccctttgcccaccagagaaacctctccaatttgcaaggatgaaaagtggaagctcctcac

SEQ ID NO: 2369 - DNA, 200 bp, Digitaria sanguinalis
ggttgtggtggacagcaagatcaatccggaccacattgagatgtatgccgagaggactgcgaaaggcaatgtccttgagccagaaggattggtggagatcaaattcaggccaaaggaactggaagattgcatgaatcgactcgacccaaagctgatatctttaaaaaccaaactaaccgaagcgaagaatagtgggacct

SEQ ID NO: 2370 - DNA, 200 bp, Digitaria sanguinalis
aggtcccactattcttcgcttcggttagtttggtttttaaagatatcagctttgggtcgagtcgattcatgcaatcttccagttcctttggcctgaatttgatctccaccaatccttctggctcaaggacattgcctttcgcagtcctctcggcatacatctcaatgtggtccggattgatcttgctgtccaccacaacc

SEQ ID NO: 2371 - DNA, 200 bp, Digitaria sanguinalis
accgaagcgaagaatagtgggacctacgggatggtcgattccgtacaacagctgataaaatcccgggaaaagcaacttctgccgctttacacgcaaatcgccacacgattcgccgagcttcacgactcggctttacgaatggcggcaaagggggtgattcgagaagttgtcgactgggggatttcacgatcttacttcta

SEQ ID NO: 2372 - DNA, 200 bp, Digitaria sanguinalis
tagaagtaagatcgtgaaatcccccagtcgacaacttctcgaatcaccccctttgccgccattcgtaaagccgagtcgtgaagctcggcgaatcgtgtggcgatttgcgtgtaaagcggcagaagttgcttttcccgggattttatcagctgttgtacggaatcgaccatcccgtaggtcccactattcttcgcttcggt

SEQ ID NO: 2373 - DNA, 200 bp, Digitaria sanguinalis
gggggatttcacgatcttacttctacaaaaggttaagaaggagaatcgccgaggcttcgttggtgaacaccgtgaaagatgcagcgggtgataagctccagcataagtcggctatggagttggtcaaaaactggtttctggactcgaaaggcgattgggaaaacgatgaagctttctatgcttggaaggataatcccgcg

SEQ ID NO: 2374 - DNA, 200 bp, Digitaria sanguinalis
cgcgggattatccttccaagcatagaaagcttcatcgttttcccaatcgcctttcgagtccagaaaccagtttttgaccaactccatagccgacttatgctggagcttatcacccgctgcatctttcacggtgttcaccaacgaagcctcggcgattctccttcttaaccttttgtagaagtaagatcgtgaaatccccc

SEQ ID NO: 2375 - DNA, 200 bp, Digitaria sanguinalis
ctatgcttggaaggataatcccgcgaattacgaggaaaagctacaggagttacgggtccagaaggtgttgcttcagttaactaacattggcgagtctttgtcggatttgaaagctttacctcaaggtcttgctgcccttctaaataaggtaattttttgggttttttcttccaggaatattgtttatttagacgatcgag

SEQ ID NO: 2376 - DNA, 200 bp, Digitaria sanguinalis
ctcgatcgtctaaataaacaatattcctggaagaaaaaacccaaaaaattaccttatttagaagggcagcaagaccttgaggtaaagctttcaaatccgacaaagactcgccaatgttagttaactgaagcaacaccttctggacccgtaactcctgtagcttttcctcgtaattcgcgggattatccttccaagcatag

SEQ ID NO: 2377 - DNA, 200 bp, Digitaria sanguinalis
aatattgtttatttagacgatcgagtcggatgttatgtaatactttatgtttgatgtaggtggagccatcgagccgaggggcgttgatcgatgagcttcggaaggtgcttaattgattttcggtaagtgtttctcggctactaaatatgttttactttggcttcagtctctgggtagtttgaatcaatagaaaatgccaa

SEQ ID NO: 2378 - DNA, 200 bp, Digitaria sanguinalis
ttggcattttctattgattcaaactacccagagactgaagccaaagtaaaacatatttagtagccgagaaacacttaccgaaaatcaattaagcaccttccgaagctcatcgatcaacgcccctcggctcgatggctccacctacatcaaacataaagtattacataacatccgactcgatcgtctaaataaacaatatt

SEQ ID NO: 2379 - DNA, 200 bp, Digitaria sanguinalis
agtttgaatcaatagaaaatgccaatgtgaaaatacccagtaatatatttgataagtgtaaatgtaactattattatatttaagtgaatagggggaattagttcatatgattattgttgttataaacaaatcagagatagagagagctatatttattattatatttgcgaattaaagttattaggagtagtataatttgg

SEQ ID NO: 2380 - DNA, 200 bp, Digitaria sanguinalis
ccaaattatactactcctaataactttaattcgcaaatataataataaatatagctctctctatctctgatttgtttataacaacaataatcatatgaactaattccccctattcacttaaatataataatagttacatttacacttatcaaatatattactgggtattttcacattggcattttctattgattcaaact

SEQ ID NO: 2381 - DNA, 200 bp, Digitaria sanguinalis
cagcctttgaaattactggatcagaaacgtcttttggcccgtaaaagcaatactacttactgctatgactttgcactggcatttgaagcagcccttgagaatatctggtcatcgaaactcccaggtgttaacaggcctggtgctaagcttgtaaatgtgacagagcttgcgtttgctgacccaagaggctcatggggtac

SEQ ID NO: 2382 - DNA, 200 bp, Digitaria sanguinalis
gtaccccatgagcctcttgggtcagcaaacgcaagctctgtcacatttacaagcttagcaccaggcctgttaacacctgggagtttcgatgaccagatattctcaagggctgcttcaaatgccagtgcaaagtcatagcagtaagtagtattgcttttacgggccaaaagacgtttctgatccagtaatttcaaaggctg

SEQ ID NO: 2383 - DNA, 200 bp, Digitaria sanguinalis
ctgacccaagaggctcatggggtacaccacttgtggaaataaaccgtgagccgggccagaacaatgtgggcatggtggcatggaccatggacctctgcacacccgagtttcctcatggaaggacaattttggtagttgcaaacgatgtcacgtttaaaaacgggtctttcggcccgattgaagacgcgtttttcgaggcg

SEQ ID NO: 2384 - DNA, 200 bp, Digitaria sanguinalis
cgcctcgaaaaacgcgtcttcaatcgggccgaaagacccgtttttaaacgtgacatcgtttgcaactaccaaaattgtccttccatgaggaaactcgggtgtgcagaggtccatggtccatgccaccatgcccacattgttctggcccggctcacggtttatttccacaagtggtgtaccccatgagcctcttgggtcag

SEQ ID NO: 2385 - DNA, 200 bp, Digitaria sanguinalis
cgtggtgtagatgacagccaagggaaatggttgggtggtatgtttgacaaggacagctttgtggagacatttgagggatgggcaaaaacagtggttactggcagagcaaagcttggaggaattcctgtcggtgtcatagctgtggagacacaaaccatgatgcagcttgtccctgctgatccaggccagcttgattccca

SEQ ID NO: 2386 - DNA, 200 bp, Digitaria sanguinalis
tgggaatcaagctggcctggatcagcagggacaagctgcatcatggtttgtgtctccacagctatgacaccgacaggaattcctccaagctttgctctgccagtaaccactgtttttgcccatccctcaaatgtctccacaaagctgtccttgtcaaacataccacccaaccatttcccttggctgtcatctacaccacg

SEQ ID NO: 2387 - DNA, 200 bp, Digitaria sanguinalis
ctgatccaggccagcttgattcccatgagcgatctgttcctcgggctggacaagtgtggttcccagattctgcaaccaagacagctcaggcattgttggatttcaaccgtgaaggattgcctctcttcatccttgccaactggagaggtttctccggtggacaaagagatctgtttgaaggaattcttcaagctgggtca

SEQ ID NO: 2388 - DNA, 200 bp, Digitaria sanguinalis
tgacccagcttgaagaattccttcaaacagatctctttgtccaccggagaaacctctccagttggcaaggatgaagagaggcaatccttcacggttgaaatccaacaatgcctgagctgtcttggttgcagaatctgggaaccacacttgtccagcccgaggaacagatcgctcatgggaatcaagctggcctggatcag

SEQ ID NO: 2389 - DNA, 200 bp, Digitaria sanguinalis
tgaaggaattcttcaagctgggtcaacaattgttgagaatcttaggacatacaatcagcctgcatttgtctacattcctatggctggagagctacgtggaggagcatgggttgtggttgatagcaaaataaatccagaccgcattgagtgttatgctgagaggactgcaaaaggcaatgtccttgaacctcaagggttaa

SEQ ID NO: 2390 - DNA, 200 bp, Digitaria sanguinalis
ttaacccttgaggttcaaggacattgccttttgcagtcctctcagcataacactcaatgcggtctggatttattttgctatcaaccacaacccatgctcctccacgtagctctccagccataggaatgtagacaaatgcaggctgattgtatgtcctaagattctcaacaattgttgacccagcttgaagaattccttca

SEQ ID NO: 2391 - DNA, 200 bp, Digitaria sanguinalis
aatgtccttgaacctcaagggttaattgaaatcaagttcagatcagaggaactccaagactgtatgggtaggcttgacccagagttgataaatctgaaagcaaaactccaaggtgcaaagcttggaaatggaagtctaccggacatagaatcccttcagaagagtatagaagctcgtacgaaacagttgttgcctttata

SEQ ID NO: 2392 - DNA, 200 bp, Digitaria sanguinalis
tataaaggcaacaactgtttcgtacgagcttctatactcttctgaagggattctatgtccggtagacttccatttccaagctttgcaccttggagttttgctttcagatttatcaactctgggtcaagcctacccatacagtcttggagttcctctgatctgaacttgatttcaattaacccttgaggttcaaggacatt

SEQ ID NO: 2393 - DNA, 200 bp, Digitaria sanguinalis
gtacgaaacagttgttgcctttatatacacagattgcaatacgttttgctgaattgcatgatacttccctcagaatggcagctaaaggtgtgattaagaaagttgtagattgggaagaatcacgttctttcttctacaaaaggctacggaggaggatctccgaagatgttcttgcaaaagaagtaagaagaatagctggt

SEQ ID NO: 2394 - DNA, 200 bp, Digitaria sanguinalis
accagctattcttcttacttcttttgcaagaacatcttcggagatcctcctccgtagccttttgtagaagaaagaacgtgattcttcccaatctacaactttcttaatcacacctttagctgccattctgagggaagtatcatgcaattcagcaaaacgtattgcaatctgtgtatataaaggcaacaactgtttcgtac

SEQ ID NO: 2395 - DNA, 200 bp, Digitaria sanguinalis
aaaagaagtaagaagaatagctggtgaccacttcactcaccaatcagcagttgagctgatcaaggaatggtacatggctgctcaaccaacaacaggaagcactgaatgggatgacgatgatgcttttgttgcctggaaggagaatcctgaaaattataagggatatatccaggagctaagggcccaaaaggtgtcccagt

SEQ ID NO: 2396 - DNA, 200 bp, Digitaria sanguinalis
actgggacaccttttgggcccttagctcctggatatatcccttataattttcaggattctccttccaggcaacaaaagcatcatcgtcatcccattcagtgcttcctgttgttggttgagcagccatgtaccattccttgatcagctcaactgctgattggtgagtgaagtggtcaccagctattcttcttacttctttt

SEQ ID NO: 2397 - DNA, 200 bp, Digitaria sanguinalis
ctaagggcccaaaaggtgtcccagtcgctctccgatctcgcaaactccacttcagatctagaagcattctctcagggtctttctgcactattagataagatggaaccctcccagagagccaattttgttcaggaagtcaagaaggtccttggttaattggatcataccaacacaatgtgtatgcaacatgttttttgttg

SEQ ID NO: 2398 - DNA, 200 bp, Digitaria sanguinalis
caacaaaaaacatgttgcatacacattgtgttggtatgatccaattaaccaaggaccttcttgacttcctgaacaaaattggctctctgggagggttccatcttatctaatagtgcagaaagaccctgagagaatgcttctagatctgaagtggagtttgcgagatcggagagcgactgggacaccttttgggcccttag

SEQ ID NO: 2399 - DNA, 200 bp, Digitaria sanguinalis
tgtgtatgcaacatgttttttgttgaagtacatacatagaaggcccttgatgagatctgatctgaatctaccattatttgttaaaatttgtttggttggacgatcatgtggttgagtaagtgctaagttgtctctgtagttctgggatgtattaccagcagttcgattgtgtaattttagagtgtatcatgcggatatta

SEQ ID NO: 2400 - DNA, 200 bp, Digitaria sanguinalis
taatatccgcatgatacactctaaaattacacaatcgaactgctggtaatacatcccagaactacagagacaacttagcacttactcaaccacatgatcgtccaaccaaacaaattttaacaaataatggtagattcagatcagatctcatcaagggccttctatgtatgtacttcaacaaaaaacatgttgcatacaca

SEQ ID NO: 2401 - DNA, 200 bp, Digitaria sanguinalis
gactgaagaaccattatttcttacgtgtttgtgagcttcaaatacaggtgtcgttgctaacattaaatatgtatctcttatttctcaggaagcatcaagcaggagctcaagcgttgttactgattatgttggttatctcagcaaaggtcagatcccaccaaaggtatactatatgctgagatgcccttattgcagattat

SEQ ID NO: 2402 - DNA, 200 bp, Digitaria sanguinalis
ataatctgcaataagggcatctcagcatatagtatacctttggtgggatctgacctttgctgagataaccaacataatcagtaacaacgcttgagctcctgcttgatgcttcctgagaaataagagatacatatttaatgttagcaacgacacctgtatttgaagctcacaaacacgtaagaaataatggttcttcagtc

SEQ ID NO: 2403 - DNA, 200 bp, Digitaria sanguinalis
ctgagatgcccttattgcagattatgcttcttgctgtttgacttaaagcagattggtaactgtgtaattcctttctgatttgcagcacatctcactcgtcaatttgaccattgctctaaacatagaggggagcaaatacacggtactcatctatagtttttctcttaacagttttgtaacctaccactgagtgtctttga

SEQ ID NO: 2404 - DNA, 200 bp, Digitaria sanguinalis
tcaaagacactcagtggtaggttacaaaactgttaagagaaaaactatagatgagtaccgtgtatttgctcccctctatgtttagagcaatggtcaaattgacgagtgagatgtgctgcaaatcagaaaggaattacacagttaccaatctgctttaagtcaaacagcaagaagcataatctgcaataagggcatctcag

SEQ ID NO: 2405 - DNA, 200 bp, Digitaria sanguinalis
gtaacctaccactgagtgtctttgagaaaaactaaatgttaaaactttgatgtagatcgagactgtgagaggtggaccccgcagctataaattaagaatgaatggatccgagattgaagcagagatacattccctgcgagatggtggacttctaatgcaggtaaatattggacccaactgtctcctttgttttcctgttg

SEQ ID NO: 2406 - DNA, 200 bp, Digitaria sanguinalis
caacaggaaaacaaaggagacagttgggtccaatatttacctgcattagaagtccaccatctcgcagggaatgtatctctgcttcaatctcggatccattcattcttaatttatagctgcggggtccacctctcacagtctcgatctacatcaaagttttaacatttagtttttctcaaagacactcagtggtaggttac

SEQ ID NO: 2407 - DNA, 200 bp, Digitaria sanguinalis
aactgtctcctttgttttcctgttgaaaaaagttctgatcaaactttgttgtatattcttcagttggatggaaacagtcatgtaatatatgcagagacggaggctgctggtacacgccttctcatcaatggcagaacatgtttactacaggtaaacatggtattcttgttctcttccacatattttttatgctgaaacac

SEQ ID NO: 2408 - DNA, 200 bp, Digitaria sanguinalis
gtgtttcagcataaaaaatatgtggaagagaacaagaataccatgtttacctgtagtaaacatgttctgccattgatgagaaggcgtgtaccagcagcctccgtctctgcatatattacatgactgtttccatccaactgaagaatatacaacaaagtttgatcagaacttttttcaacaggaaaacaaaggagacagtt

SEQ ID NO: 2409 - DNA, 200 bp, Digitaria sanguinalis
ccacatattttttatgctgaaacacactacctgttacatatctttacttgaaactgaagttattggatctggcaattttttacgaatgtttctttcatatgaaggtcatagaaattataggttacatagagggtagagaatacaatttaggaagctactatgacgcatagccctaagttatataaatttgcttgaacgta

SEQ ID NO: 2410 - DNA, 200 bp, Digitaria sanguinalis
tacgttcaagcaaatttatataacttagggctatgcgtcatagtagcttcctaaattgtattctctaccctctatgtaacctataatttctatgaccttcatatgaaagaaacattcgtaaaaaattgccagatccaataacttcagtttcaagtaaagatatgtaacaggtagtgtgtttcagcataaaaaatatgtgg

SEQ ID NO: 2411 - DNA, 200 bp, Digitaria sanguinalis
agttatataaatttgcttgaacgtagatttgcttcgtcctctttatgttttcagcttggcattttccataacggtggttgttccatgtgtcaaagcatctaatgttagctagtattctcagttgccaaagataaaagatatcccagttacctactagcccactaaaagtttgtaacaatgtgaaattttacttgaaggaa

SEQ ID NO: 2412 - DNA, 200 bp, Digitaria sanguinalis
ttccttcaagtaaaatttcacattgttacaaacttttagtgggctagtaggtaactgggatatcttttatctttggcaactgagaatactagctaacattagatgctttgacacatggaacaaccaccgttatggaaaatgccaagctgaaaacataaagaggacgaagcaaatctacgttcaagcaaatttatataact

SEQ ID NO: 2413 - DNA, 200 bp, Digitaria sanguinalis
caatgtgaaattttacttgaaggaataagcagtttggattgtttcaattcttaaccgtattctcacatcatatggaaatacatgatattgttttttcttctcttgattatatttcacagaaagaacacgatccttcaaagttgttggctgatacaccgtgcaaacttcttcggttcttggttgcggatggctctcatgtg

SEQ ID NO: 2414 - DNA, 200 bp, Digitaria sanguinalis
cacatgagagccatccgcaaccaagaaccgaagaagtttgcacggtgtatcagccaacaactttgaaggatcgtgttctttctgtgaaatataatcaagagaagaaaaaacaatatcatgtatttccatatgatgtgagaatacggttaagaattgaaacaatccaaactgcttattccttcaagtaaaatttcacattg

SEQ ID NO: 2415 - DNA, 200 bp, Digitaria sanguinalis
cttggttgcggatggctctcatgtggatgctgatacaccatatgctgaggtggaagtcatgaagatgtgcatgccactgctagtgcctgcctctggtgtcattcacttcgttatgcctgagggtcaggccatgcaggtattattcctctttatttttctccccctctgctcttgcttctttcattttataaaaaccttaa

SEQ ID NO: 2416 - DNA, 200 bp, Digitaria sanguinalis
ttaaggtttttataaaatgaaagaagcaagagcagagggggagaaaaataaagaggaataatacctgcatggcctgaccctcaggcataacgaagtgaatgacaccagaggcaggcactagcagtggcatgcacatcttcatgacttccacctcagcatatggtgtatcagcatccacatgagagccatccgcaaccaag

SEQ ID NO: 2417 - DNA, 200 bp, Digitaria sanguinalis
ttctttcattttataaaaaccttaaatgtatgttttcctttttttttcaggcgaatgacttaatagcaagattggaccttgatgacccatcttctgtgaggagagctgaaccgtttcatggctccttccccaaattgggacctcctactgctatttctggcaaagttcatcaaaaatttgctgcaagcgtgaattctgca

SEQ ID NO: 2418 - DNA, 200 bp, Digitaria sanguinalis
tgcagaattcacgcttgcagcaaatttttgatgaactttgccagaaatagcagtaggaggtcccaatttggggaaggagccatgaaacggttcagctctcctcacagaagatgggtcatcaaggtccaatcttgctattaagtcattcgcctgaaaaaaaaaggaaaacatacatttaaggtttttataaaatgaaagaa

SEQ ID NO: 2419 - DNA, 200 bp, Digitaria sanguinalis
atttgctgcaagcgtgaattctgcacacatgatccttgcaggctatgaacataatatcaatgaggtaagacatataattatttttaatttcaaattaattttcatttttaacttccctttcattatcttcatctgcgaagaacccaatttcatggtttataacacaccacactatcgctgagagcaattgggattgcgtg

SEQ ID NO: 2420 - DNA, 200 bp, Digitaria sanguinalis
cacgcaatcccaattgctctcagcgatagtgtggtgtgttataaaccatgaaattgggttcttcgcagatgaagataatgaaagggaagttaaaaatgaaaattaatttgaaattaaaaataattatatgtcttacctcattgatattatgttcatagcctgcaaggatcatgtgtgcagaattcacgcttgcagcaaat

SEQ ID NO: 2421 - DNA, 200 bp, Digitaria sanguinalis
cgctgagagcaattgggattgcgtggaataatagattgattagggtatacatgatacaggatatataggcagccttaagaggtttatagaatcacagggcagccttgagaggtttatagaatcacaaccaatcaaggatgcctgcctttcctaaccaacagagcacagccagaggccagcacaagtcctggcacaaattc

SEQ ID NO: 2422 - DNA, 200 bp, Digitaria sanguinalis
gaatttgtgccaggacttgtgctggcctctggctgtgctctgttggttaggaaaggcaggcatccttgattggttgtgattctataaacctctcaaggctgccctgtgattctataaacctcttaaggctgcctatatatcctgtatcatgtataccctaatcaatctattattccacgcaatcccaattgctctcagcg

SEQ ID NO: 2423 - DNA, 200 bp, Digitaria sanguinalis
gagaagaaaaggggtatcatggttgtaatcaagtctctccagtttctagcaactgcaattgatgctgcactgaaggagacctcgcaatatagagcaggtgctgtaagtgtctcgaatggtaaccatgtaaattcaaatcaaagcaatatgctgcatattgctttggttggtatcagtaatcagatgagtacactccaaga

SEQ ID NO: 2424 - DNA, 200 bp, Digitaria sanguinalis
tcttggagtgtactcatctgattactgataccaaccaaagcaatatgcagcatattgctttgatttgaatttacatggttaccattcgagacacttacagcacctgctctatattgcgaggtctccttcagtgcagcatcaattgcagttgctagaaactggagagacttgattacaaccatgataccccttttcttctc

SEQ ID NO: 2425 - DNA, 200 bp, Digitaria sanguinalis
gtaatcagatgagtacactccaagacagtggtgacgaggatcaagcacaggaaaggatcaacaaactttccaaaattttgaaggataatactattacatcgcagcttaatggtgctggtgttaaggtcgtcagctgcattatccaaagagatgaagggcgtccaccaatgcgacactccttccattggtctgctgacaag

SEQ ID NO: 2426 - DNA, 200 bp, Digitaria sanguinalis
cttgtcagcagaccaatggaaggagtgtcgcattggtggacgcccttcatctctttggataatgcagctgacgaccttaacaccagcaccattaagctgcgatgtaatagtattatccttcaaaattttggaaagtttgttgatcctttcctgtgcttgatcctcgtcaccactgtcttggagtgtactcatctgattac

SEQ ID NO: 2427 - DNA, 200 bp, Digitaria sanguinalis
ctccttccattggtctgctgacaagctttattatgaggaggatccaatgctccgccacgtggaaccaccattgtctacattccttgagctggacaaagtaaatttggagggttacactgaagtaaaatacaccccatcacgtgatcgtcagtggcatatttacacacttatcaagaacaagaaagatcagagattaaacg

SEQ ID NO: 2428 - DNA, 200 bp, Digitaria sanguinalis
cgtttaatctctgatctttcttgttcttgataagtgtgtaaatatgccactgacgatcacgtgatggggtgtattttacttcagtgtaaccctccaaatttactttgtccagctcaaggaatgtagacaatggtggttccacgtggcggagcattggatcctcctcataataaagcttgtcagcagaccaatggaaggag

SEQ ID NO: 2429 - DNA, 200 bp, Digitaria sanguinalis
gcaagcgaacttcttgaacaaactaaactaagtgaactccgtgcaagcatcgcaagaagcctttctgatctggggatgcataagggagaaatgactattaaggatagcatggaagagttagtctctgccccattgcctgttgaagatgcacttatttccttgtttgattacagtgatccaactgttcagcggaaagtggt

SEQ ID NO: 2430 - DNA, 200 bp, Digitaria sanguinalis
accactttccgctgaacagttggatcactgtaatcaaacaaggaaataagtgcatcttcaacaggcaatggggcagagactaactcttccatgctatccttaatagtcatttctcccttatgcatccccagatcagaaaggcttcttgcgatgcttgcacggagttcacttagtttagtttgttcaagaagttcgcttgc

SEQ ID NO: 2431 - DNA, 200 bp, Digitaria sanguinalis
atccaactgttcagcggaaagtggttgaaacatacatatctcgattatatcagcctcttcttgtgaaggatagcatccaaatgaaacttaaggaatctggtgccgttgctttttgggaattttctgatgagcatgctgacactaaaaatggacaagaagctgttcttggtcaaaagagatggggggccatggttgtcatc

SEQ ID NO: 2432 - DNA, 200 bp, Digitaria sanguinalis
gatgacaaccatggccccccatctcttttgaccaagaacagcttcttgtccatttttagtgtcagcatgctcatcagaaaattcccaaaaagcaacggcaccagattccttaagtttcatttggatgctatccttcacaagaagaggctgatataatcgagatatgtatgtttcaaccactttccgctgaacagttggat

SEQ ID NO: 2433 - DNA, 200 bp, Digitaria sanguinalis
gagatggggggccatggttgtcatcaaatcacttgaatctgcgcgaacagccattgtagatgcattaaaggattcggcatggcaatccagctctgagggcaacatgatgcacattgcattattgagttctgaaaatgaaaataatatcagcagtgatgatcaagctcaacataggatggaaaaaattaccaagatattca

SEQ ID NO: 2434 - DNA, 200 bp, Digitaria sanguinalis
tgaatatcttggtaattttttccatcctatgttgagcttgatcatcactgctgatattattttcattttcagaactcaataatgcaatgtgcatcatgttgccctcagagctggattgccatgccgaatcctttaatgcatctacaatggctgttcgcgcagattcaagtgatttgatgacaaccatggccccccatctc

SEQ ID NO: 2435 - DNA, 200 bp, Digitaria sanguinalis
atggaaaaaattaccaagatattcaaggatagtggtgttgtaaacgatctccgatctgctggtttgaaggttataagttgcattgttcaaagagatgaagtacgcatgccaatgcgccacacattcctctggtcagatgaaaagagttgttatgaggaagaacagattctccgccatgtggagcctcccctctctgcgct

SEQ ID NO: 2436 - DNA, 200 bp, Digitaria sanguinalis
agcgcagagaggggaggctccacatggcggagaatctgttcttcctcataacaactcttttcatctgaccagaggaatgtgtggcgcattggcatgcgtacttcatctctttgaacaatgcaacttataaccttcaaaccagcagatcggagatcgtttacaacaccactatccttgaatatcttggtaattttttccat

SEQ ID NO: 2437 - DNA, 200 bp, Digitaria sanguinalis
atgtggagcctcccctctctgcgcttcttgaattggacaagttgaaagtgaaaggatacaatgaaatgaagtatactccatcacgcgaccgtcaatggcatatctacacactaaggaatactgaaaaccccaaaatgttgcatagggtatttttccgaactattgtcaggcaactgaatgcagacaacaaatttgcatca

SEQ ID NO: 2438 - DNA, 200 bp, Digitaria sanguinalis
tgatgcaaatttgttgtctgcattcagttgcctgacaatagttcggaaaaataccctatgcaacattttggggttttcagtattccttagtgtgtagatatgccattgacggtcgcgtgatggagtatacttcatttcattgtatcctttcactttcaacttgtccaattcaagaagcgcagagaggggaggctccacat

SEQ ID NO: 2439 - DNA, 200 bp, Digitaria sanguinalis
gaatgcagacaacaaatttgcatcagcccaagttagcaacactgaagttggaggtctggaggaatctttgtcatctacatcaaatagcattttaagatcgttgattactgctattgaagaattagagcttcatgcgattaggacaggtcattctcacatgtatttatgcatattgaaagaacaaaagcttcttgatctca

SEQ ID NO: 2440 - DNA, 200 bp, Digitaria sanguinalis
tgagatcaagaagcttttgttctttcaatatgcataaatacatgtgagaatgacctgtcctaatcgcatgaagctctaattcttcaatagcagtaatcaacgatcttaaaatgctatttgatgtagatgacaaagattcctccagacctccaacttcagtgttgctaacttgggctgatgcaaatttgttgtctgcattc

SEQ ID NO: 2441 - DNA, 200 bp, Digitaria sanguinalis
gttgttgcaaaatgaatgtgacatttaaagctgggtcctttggtccaagagaagatgcgttttttgatgctgttaccaatcttgcttgtgagaggaaacttcctcttatctacctggctgcaactgctggtgccagacttggtgtagcagaggaaataaaggcatgcttccatgtcggctggtctgatgatgagagccct

SEQ ID NO: 2442 - DNA, 200 bp, Digitaria sanguinalis
agggctctcatcatcagaccagccgacatggaagcatgcctttatttcctctgctacaccaagtctggcaccagcagttgcagccaggtagataagaggaagtttcctctcacaagcaagattggtaacagcatcaaaaaacgcatcttctcttggaccaaaggacccagctttaaatgtcacattcattttgcaacaac

SEQ ID NO: 2443 - DNA, 200 bp, Digitaria sanguinalis
cggctggtctgatgatgagagccctgaacgtggttttcactacatctacctaactgaacaagactattcacgtctaagctcttcagttatagctcacgagctgaaactagaaaatggagaaaccagatgggtggttgataccattgttgggaaagaggatggacttggttgtgagaatctacatggaagtggtgcgattg

SEQ ID NO: 2444 - DNA, 200 bp, Digitaria sanguinalis
caatcgcaccacttccatgtagattctcacaaccaagtccatcctctttcccaacaatggtatcaaccacccatctggtttctccattttctagtttcagctcgtgagctataactgaagagcttagacgtgaatagtcttgttcagttaggtagatgtagtgaaaaccacgttcagggctctcatcatcagaccagccg

SEQ ID NO: 2445 - DNA, 200 bp, Digitaria sanguinalis
aatctacatggaagtggtgcgattgccagcgcgtattctaaggcatacaaagagaccttcaccctgacatttgtgactggaagagctgttggcattggagcttacctggctcgtttaggtatgaggtgcatacaacgtcttgatcaaccaattattttgactgggttttctgcattgaacaagcttctgggacgggaggt

SEQ ID NO: 2446 - DNA, 200 bp, Digitaria sanguinalis
acctcccgtcccagaagcttgttcaatgcagaaaacccagtcaaaataattggttgatcaagacgttgtatgcacctcatacctaaacgagccaggtaagctccaatgccaacagctcttccagtcacaaatgtcagggtgaaggtctctttgtatgccttagaatacgcgctggcaatcgcaccacttccatgtagatt

SEQ ID NO: 2447 - DNA, 200 bp, Digitaria sanguinalis
tgaacaagcttctgggacgggaggtatacagttctcatatgcaattgggtggccccaaaatcatggctacaaatggtgttgtccaccagaccgtgtcagatgatcttgaaggtgtttctgctatcctgaaatggctcagttacgttcctccctatgttggtggtcctcttcctattatgaaacccttggacccaccagaa

SEQ ID NO: 2448 - DNA, 200 bp, Digitaria sanguinalis
ttctggtgggtccaagggtttcataataggaagaggaccaccaacatagggaggaacgtaactgagccatttcaggatagcagaaacaccttcaagatcatctgacacggtctggtggacaacaccatttgtagccatgattttggggccacccaattgcatatgagaactgtatacctcccgtcccagaagcttgttca

SEQ ID NO: 2449 - DNA, 200 bp, Digitaria sanguinalis
tatgaaacccttggacccaccagaaagacctgtaacatacttccctgagaatgcatgtgatgctcatgccgctatatgcggcattcaggacggtgaaggcaagtggttgggtggtatgtttgacaaggaaagcttcgtggaaacattggaaggctgggcaaaaactgttatcaccgggagagcaaaacttggtggaatac

SEQ ID NO: 2450 - DNA, 200 bp, Digitaria sanguinalis
gtattccaccaagttttgctctcccggtgataacagtttttgcccagccttccaatgtttccacgaagctttccttgtcaaacataccacccaaccacttgccttcaccgtcctgaatgccgcatatagcggcatgagcatcacatgcattctcagggaagtatgttacaggtctttctggtgggtccaagggtttcata

SEQ ID NO: 2451 - DNA, 200 bp, Digitaria sanguinalis
gggagagcaaaacttggtggaataccagttggtgtcatagctgtggaaacccagacagtgatgcaagtcatccctgctgatccagggcagcttgattccgctgagcgtgtagtccctcaagcaggacaagtgtggttccctgattctgccaccaaaacggctcaggcattgatggatttcaaccgtgaggagcttccact

SEQ ID NO: 2452 - DNA, 200 bp, Digitaria sanguinalis
agtggaagctcctcacggttgaaatccatcaatgcctgagccgttttggtggcagaatcagggaaccacacttgtcctgcttgagggactacacgctcagcggaatcaagctgccctggatcagcagggatgacttgcatcactgtctgggtttccacagctatgacaccaactggtattccaccaagttttgctctccc

SEQ ID NO: 2453 - DNA, 200 bp, Digitaria sanguinalis
atttcaaccgtgaggagcttccacttttcatccttgcaaattggagaggtttctctggtggacaaagggatttgtttgaagggatacttcaggctggttcaacaattgttgagaatctgaggacatacaagcagcctgctttcgtatatatcccaatgggtggagagctgcggggaggagcctgggttgtggtggacagc

SEQ ID NO: 2454 - DNA, 200 bp, Digitaria sanguinalis
gctgtccaccacaacccaggctcctccccgcagctctccacccattgggatatatacgaaagcaggctgcttgtatgtcctcagattctcaacaattgttgaaccagcctgaagtatcccttcaaacaaatccctttgtccaccagagaaacctctccaatttgcaaggatgaaaagtggaagctcctcacggttgaaat

SEQ ID NO: 2455 - DNA, 200 bp, Digitaria sanguinalis
aggagcctgggttgtggtggacagcaagatcaatccggaccacattgagatgtatgcggagaggactgcgaaaggcaatgtccttgagccagaaggattggtggagatcaaattcaggccaaaggaactggaagattgcatgctaaggcttgatccagaattgattggcctgaatgctaggctgaaagagttgaagaagc

SEQ ID NO: 2456 - DNA, 200 bp, Digitaria sanguinalis
gcttcttcaactctttcagcctagcattcaggccaatcaattctggatcaagccttagcatgcaatcttccagttcctttggcctgaatttgatctccaccaatccttctggctcaaggacattgcctttcgcagtcctctccgcatacatctcaatgtggtccggattgatcttgctgtccaccacaacccaggctcct

SEQ ID NO: 2457 - DNA, 200 bp, Digitaria sanguinalis
gctaggctgaaagagttgaagaagcaaaatgccagcaactcggaaacggagaccatccgtaagagtatgacagttcggatgaagcagctaatgcctatatatactcaggttgccacacggtttgctgagttgcatgacacctccgctagaatggctgcaaaaggcgtaattggtaaggttgttgattgggaggagtctcg

SEQ ID NO: 2458 - DNA, 200 bp, Digitaria sanguinalis
cgagactcctcccaatcaacaaccttaccaattacgccttttgcagccattctagcggaggtgtcatgcaactcagcaaaccgtgtggcaacctgagtatatataggcattagctgcttcatccgaactgtcatactcttacggatggtctccgtttccgagttgctggcattttgcttcttcaactctttcagcctagc

SEQ ID NO: 2459 - DNA, 200 bp, Digitaria sanguinalis
tctctctctctctctctcggctatgttcttcgcttgcttctcagctctgcaccgctcgggcgatcgaatttcgcattgctccgtgtgccgccggccgctcgaggctgtccgcgtccaaatccaactccaaaacgcgacttcgcgcggcgccgacgctactaaatcgccgcttgtacttctcagccgcgccgggcaacttg

SEQ ID NO: 2460 - DNA, 200 bp, Digitaria sanguinalis
caagttgcccggcgcggctgagaagtacaagcggcgatttagtagcgtcggcgccgcgcgaagtcgcgttttggagttggatttggacgcggacagcctcgagcggccggcggcacacggagcaatgcgaaattcgatcgcccgagcggtgcagagctgagaagcaagcgaagaacatagccgagagagagagagagaga

SEQ ID NO: 2461 - DNA, 200 bp, Digitaria sanguinalis
cttctcagccgcgccgggcaacttgcttcggcgttccgtcgagcaggttgtgcgcgcgccaagtgtgattggggaaatagagatcctgcctgctgctggcaaccggaatttcgtcaatcaaaggcagggggtttccttttcagtttggttagggagcttgttgttttgtttgttggggtgccggggttggtcccctctgt

SEQ ID NO: 2462 - DNA, 200 bp, Digitaria sanguinalis
acagaggggaccaaccccggcaccccaacaaacaaaacaacaagctccctaaccaaactgaaaaggaaaccccctgcctttgattgacgaaattccggttgccagcagcaggcaggatctctatttccccaatcacacttggcgcgcgcacaacctgctcgacggaacgccgaagcaagttgcccggcgcggctgagaag

SEQ ID NO: 2463 - DNA, 200 bp, Digitaria sanguinalis
gggtgccggggttggtcccctctgttttggattggattgtagtggcctttcgggtttccactttggactcgcctctagtgcggacctttctgtgatcgcataacacatactacggtcaatatattagtcacctttgcctaggtataatcaaaacctgtgtcctgacacttcttattctgctggctgcttgtactctaatt

SEQ ID NO: 2464 - DNA, 200 bp, Digitaria sanguinalis
aattagagtacaagcagccagcagaataagaagtgtcaggacacaggttttgattatacctaggcaaaggtgactaatatattgaccgtagtatgtgttatgcgatcacagaaaggtccgcactagaggcgagtccaaagtggaaacccgaaaggccactacaatccaatccaaaacagaggggaccaaccccggcaccc

SEQ ID NO: 2465 - DNA, 200 bp, Digitaria sanguinalis
tctgctggctgcttgtactctaattcaatacaatcagctgctgcctatggatgaatctggttaaatagccacttctctgttatcaactctatatcatctcagcacactatttcatatactactagttgcctgtccgaaagtatcgtgcttgcgatttgtttcttttgcctgttcgatagtcatgcagtttccccgtcaca

SEQ ID NO: 2466 - DNA, 200 bp, Digitaria sanguinalis
tgtgacggggaaactgcatgactatcgaacaggcaaaagaaacaaatcgcaagcacgatactttcggacaggcaactagtagtatatgaaatagtgtgctgagatgatatagagttgataacagagaagtggctatttaaccagattcatccataggcagcagctgattgtattgaattagagtacaagcagccagcaga

SEQ ID NO: 2467 - DNA, 200 bp, Digitaria sanguinalis
atagtcatgcagtttccccgtcacaattgatgtactaacaatctgtttcttttgcactgaccaggaagtttgaacttcagagggtgagataatggttgagcctgaccagatgaacggcatactgaatgggatgcctaatttgaggcacccgtcctctccatcaaaggtcgatgaattctgtaaagcacttggtggcgact

SEQ ID NO: 2468 - DNA, 200 bp, Digitaria sanguinalis
agtcgccaccaagtgctttacagaattcatcgacctttgatggagaggacgggtgcctcaaattaggcatcccattcagtatgccgttcatctggtcaggctcaaccattatctcaccctctgaagttcaaacttcctggtcagtgcaaaagaaacagattgttagtacatcaattgtgacggggaaactgcatgactat

SEQ ID NO: 2469 - DNA, 200 bp, Digitaria sanguinalis
ttctgtaaagcacttggtggcgactcgccaatacacagtgtgctagttgccaacaatgggatggccgcggtcaagttcatgcgcagcatccgcacatgggccttggagacctttgggacagagaaggccattctcttggttgctatggccactccggaggacttgaggataaacgccgagcacataagaattgctgacca

SEQ ID NO: 2470 - DNA, 200 bp, Digitaria sanguinalis
tggtcagcaattcttatgtgctcggcgtttatcctcaagtcctccggagtggccatagcaaccaagagaatggccttctctgtcccaaaggtctccaaggcccatgtgcggatgctgcgcatgaacttgaccgcggccatcccattgttggcaactagcacactgtgtattggcgagtcgccaccaagtgctttacagaa

SEQ ID NO: 2471 - DNA, 200 bp, Digitaria sanguinalis
ccgagcacataagaattgctgaccaattcatagaagttcctggaggaacaaataataacaactatgcgaatgtacagctcattgtcgaggttagcacaactcatcatcctggaagtgactaacttgtgtttagtttacatatgttttcactctggacaattcagtaattaacactgaattcacatttcacagatagcaga

SEQ ID NO: 2472 - DNA, 200 bp, Digitaria sanguinalis
tctgctatctgtgaaatgtgaattcagtgttaattactgaattgtccagagtgaaaacatatgtaaactaaacacaagttagtcacttccaggatgatgagttgtgctaacctcgacaatgagctgtacattcgcatagttgttattatttgttcctccaggaacttctatgaattggtcagcaattcttatgtgctcgg

SEQ ID NO: 2473 - DNA, 200 bp, Digitaria sanguinalis
gaattcacatttcacagatagcagagagaactcgtgtctctgcagtttggcctggctggggtcatgcatctgagaatccagagcttccggatgctctaaacgaaaaaggaataattttccttgggccaccatcagctgcaatgtctgcactcggtgataagattggttcttctcttattgcacaagcagcaggagttcca

SEQ ID NO: 2474 - DNA, 200 bp, Digitaria sanguinalis
tggaactcctgctgcttgtgcaataagagaagaaccaatcttatcaccgagtgcagacattgcagctgatggtggcccaaggaaaattattcctttttcgtttagagcatccggaagctctggattctcagatgcatgaccccagccaggccaaactgcagagacacgagttctctctgctatctgtgaaatgtgaattc

SEQ ID NO: 2475 - DNA, 200 bp, Digitaria sanguinalis
tattgcacaagcagcaggagttccaactcttccatggagtggatcacatgtatgccttcgcctatttctgtgtgcctttgcttctaacttttatctgctagtttaatattcacttaacattgaaccaaactcactgcaggtgaaagttccaccagaaagctgccactcgattcctgaggagatatataaggatgcttgtg

SEQ ID NO: 2476 - DNA, 200 bp, Digitaria sanguinalis
cacaagcatccttatatatctcctcaggaatcgagtggcagctttctggtggaactttcacctgcagtgagtttggttcaatgttaagtgaatattaaactagcagataaaagttagaagcaaaggcacacagaaataggcgaaggcatacatgtgatccactccatggaagagttggaactcctgctgcttgtgcaata

SEQ ID NO: 2477 - DNA, 200 bp, Digitaria sanguinalis
gaggagatatataaggatgcttgtgtttccactacagaggaagcagtggctagttgccaggtggtcgggtatcctgccatgatcaaggcatcatggggtggcggtggtaaaggaataaggaaggttggttttctttttctatttgaatctgagaaaaaagaagggaaatgtccagtattcagaaaacatgatctgaaagt

SEQ ID NO: 2478 - DNA, 200 bp, Digitaria sanguinalis
actttcagatcatgttttctgaatactggacatttcccttcttttttctcagattcaaatagaaaaagaaaaccaaccttccttattcctttaccaccgccaccccatgatgccttgatcatggcaggatacccgaccacctggcaactagccactgcttcctctgtagtggaaacacaagcatccttatatatctcctc

SEQ ID NO: 2479 - DNA, 200 bp, Digitaria sanguinalis
tattcagaaaacatgatctgaaagtttcaaggaaaaagttagagtaaattaacactaattttgatatcatttgcatggattcataggtacacaatgatgatgaggtgagggcactgttcaagcaagttcaaggagaagtccctggctcacctatttttattatgaaagtggcatctcaggtgagaactgattcaacaaat

SEQ ID NO: 2480 - DNA, 200 bp, Digitaria sanguinalis
atttgttgaatcagttctcacctgagatgccactttcataataaaaataggtgagccagggacttctccttgaacttgcttgaacagtgccctcacctcatcatcattgtgtacctatgaatccatgcaaatgatatcaaaattagtgttaatttactctaactttttccttgaaactttcagatcatgttttctgaata

SEQ ID NO: 2481 - DNA, 200 bp, Digitaria sanguinalis
tcaggtgagaactgattcaacaaattttggctatttaatggtttgctttggcgcccacctttgttctttgtatcctgagctcttctatgtggttgcatttgtttctgaaagcttttgtttgttctttctttgtagagccgacatctggaggttcagttgctctgtgacaaacatggcaatgtggctgcactgcacagtcg

SEQ ID NO: 2482 - DNA, 200 bp, Digitaria sanguinalis
cgactgtgcagtgcagccacattgccatgtttgtcacagagcaactgaacctccagatgtcggctctacaaagaaagaacaaacaaaagctttcagaaacaaatgcaaccacatagaagagctcaggatacaaagaacaaaggtgggcgccaaagcaaaccattaaatagccaaaatttgttgaatcagttctcacctga

SEQ ID NO: 2483 - DNA, 200 bp, Digitaria sanguinalis
gcaatgtggctgcactgcacagtcgagattgtagtgttcaaagaaggcaccaaaaggttagctcgtagaattttttctaagctttgatttacattgtgatttcttgtaatttgtcccatacttggattgtgtagtgtgctgtatagtagttttatatatttcttgaataaagtttaggtgacctagtgcaagacgaaaaa

SEQ ID NO: 2484 - DNA, 200 bp, Digitaria sanguinalis
tttttcgtcttgcactaggtcacctaaactttattcaagaaatatataaaactactatacagcacactacacaatccaagtatgggacaaattacaagaaatcacaatgtaaatcaaagcttagaaaaaattctacgagctaaccttttggtgccttctttgaacactacaatctcgactgtgcagtgcagccacattgc

SEQ ID NO: 2485 - DNA, 200 bp, Digitaria sanguinalis
ttcagttggatggaaatagccatgtaatttatgcggaagaagaagctggtggtacacgacttcagattgatggaaagacatgcttgttacaggtgcatatgctcttttccctttattatcttcttggtgtctgattgggagtcttctgccagatttgccttttccgtttattacaacaatttgtctgtcatccttaactt

SEQ ID NO: 2486 - DNA, 200 bp, Digitaria sanguinalis
aagttaaggatgacagacaaattgttgtaataaacggaaaaggcaaatctggcagaagactcccaatcagacaccaagaagataataaagggaaaagagcatatgcacctgtaacaagcatgtctttccatcaatctgaagtcgtgtaccaccagcttcttcttccgcataaattacatggctatttccatccaactgaa

SEQ ID NO: 2487 - DNA, 200 bp, Digitaria sanguinalis
acaatttgtctgtcatccttaacttcagaaaatcctattgtttgctttcttagcatacttgatttcagtgaaatttgactacaatacctgaattaaaaaaaaactgtaatcgtgtgattaaaaatcaagaagtagcctttttaggattgtaatattttggtattgctacactatgccagaagtaggtcacaagtgtgtgt

SEQ ID NO: 2488 - DNA, 200 bp, Digitaria sanguinalis
acacacacttgtgacctacttctggcatagtgtagcaataccaaaatattacaatcctaaaaaggctacttcttgatttttaatcacacgattacagtttttttttaattcaggtattgtagtcaaatttcactgaaatcaagtatgctaagaaagcaaacaataggattttctgaagttaaggatgacagacaaattgt

SEQ ID NO: 2489 - DNA, 200 bp, Digitaria sanguinalis
ccagaagtaggtcacaagtgtgtgttcttgcagaatgattatgatccatcaaagttagtagctgagacaccctgcaagcttcttcggttcttagttgctgatggtgctcatgttgatgccgatgtaccatatgcggaagttgaggttatgaagatgtgcatgcctctcttgtcccctgcttctggtgtcatacatgttat

SEQ ID NO: 2490 - DNA, 200 bp, Digitaria sanguinalis
ataacatgtatgacaccagaagcaggggacaagagaggcatgcacatcttcataacctcaacttccgcatatggtacatcggcatcaacatgagcaccatcagcaactaagaaccgaagaagcttgcagggtgtctcagctactaactttgatggatcataatcattctgcaagaacacacacttgtgacctacttctgg

SEQ ID NO: 2491 - DNA, 200 bp, Digitaria sanguinalis
ctgcttctggtgtcatacatgttatgatgtctgagggccaggcattgcaggttatttttgtacatccctccttgcattgtgcttgcatcacataactgcatgtaacatttttagacttatattttgttctaggctggtgatcttatagcgaggctggatcttgatgacccttctgctgtgaaaagagctgaaccatttga

SEQ ID NO: 2492 - DNA, 200 bp, Digitaria sanguinalis
tcaaatggttcagctcttttcacagcagaagggtcatcaagatccagcctcgctataagatcaccagcctagaacaaaatataagtctaaaaatgttacatgcagttatgtgatgcaagcacaatgcaaggagggatgtacaaaaataacctgcaatgcctggccctcagacatcataacatgtatgacaccagaagcag

SEQ ID NO: 2493 - DNA, 200 bp, Digitaria sanguinalis
ctgtgaaaagagctgaaccatttgatggaatatttccacaaatgggtcttcctgttgctgcctctagtcaagtacacaaaagatatgcttcaagtttgaatgctgctcgaatggtccttgcaggatatgagcataatatcaacgaagtaaatattccatcttattatgattatactctatttagtttttttttaatcttt

SEQ ID NO: 2494 - DNA, 200 bp, Digitaria sanguinalis
aaagattaaaaaaaaactaaatagagtataatcataataagatggaatatttacttcgttgatattatgctcatatcctgcaaggaccattcgagcagcattcaaacttgaagcatatcttttgtgtacttgactagaggcagcaacaggaagacccatttgtggaaatattccatcaaatggttcagctcttttcacag

SEQ ID NO: 2495 - DNA, 200 bp, Digitaria sanguinalis
tctatttagtttttttttaatcttttgtttcctttactttgatttgtgtactccatcccaaaacagtgtgattctagtgttgtcctaagtatcattagattcatcatgaaatatattttgggactgttttgagggttcacacgggttcaatgtttttttttttggttctgctgacttttcgtccaaacttgtataatcta

SEQ ID NO: 2496 - DNA, 200 bp, Digitaria sanguinalis
tagattatacaagtttggacgaaaagtcagcagaaccaaaaaaaaaaacattgaacccgtgtgaaccctcaaaacagtcccaaaatatatttcatgatgaatctaatgatacttaggacaacactagaatcacactgttttgggatggagtacacaaatcaaagtaaaggaaacaaaagattaaaaaaaaactaaataga

SEQ ID NO: 2497 - DNA, 200 bp, Digitaria sanguinalis
ttttcgtccaaacttgtataatctatggaaaattgtaatggtaagtacgttctgatcatgctcacatagtcacactagtgtaactttatattctagtttgataattttgagtcgcacttatttaattgaagttattgcattttgttttctatcacattgtccttagcatttatttatcacatattgattgattcgctcga

SEQ ID NO: 2498 - DNA, 200 bp, Digitaria sanguinalis
tcgagcgaatcaatcaatatgtgataaataaatgctaaggacaatgtgatagaaaacaaaatgcaataacttcaattaaataagtgcgactcaaaattatcaaactagaatataaagttacactagtgtgactatgtgagcatgatcagaacgtacttaccattacaattttccatagattatacaagtttggacgaaaa

SEQ ID NO: 2499 - DNA, 200 bp, Digitaria sanguinalis
atcacatattgattgattcgctcgaaactctttttttttccaggttgtgcaagatatgatatgctgtctggacaatccggagcttcctttcctacagtgggatgaacttatgtctgttctagcaactagacttccaagaaaccttaagagtgaggtataagacaattaccaaaatgtagccaatctgggttaaatgaaag

SEQ ID NO: 2500 - DNA, 200 bp, Digitaria sanguinalis
ctttcatttaacccagattggctacattttggtaattgtcttatacctcactcttaaggtttcttggaagtctagttgctagaacagacataagttcatcccactgtaggaaaggaagctccggattgtccagacagcatatcatatcttgcacaacctggaaaaaaaaagagtttcgagcgaatcaatcaatatgtgat

SEQ ID NO: 2501 - DNA, 200 bp, Digitaria sanguinalis
gtagccaatctgggttaaatgaaagacgattcattttactgtgtatattatcttaattttacatattggcttatgttgatgacagaaaagtttggtatcaccagagtaaaaccgtgatattttgtagcactggtttgcactgtgttacgtgcattaaagtctatagtgtgctgtagtttattatgtaaaattaagttgta

SEQ ID NO: 2502 - DNA, 200 bp, Digitaria sanguinalis
tacaacttaattttacataataaactacagcacactatagactttaatgcacgtaacacagtgcaaaccagtgctacaaaatatcacggttttactctggtgataccaaacttttctgtcatcaacataagccaatatgtaaaattaagataatatacacagtaaaatgaatcgtctttcatttaacccagattggctac

SEQ ID NO: 2503 - DNA, 200 bp, Digitaria sanguinalis
gtttattatgtaaaattaagttgtattcatgtgctaaaatttagaatctttcactttagcatcttaatagatagaagctgaatcttccagtaagttttgttttagtttcttgattgtaggtctcttgtatgtccttgcataaccctttttcattctagatctgatggttctatcttttattatgcagttagaggataaat

SEQ ID NO: 2504 - DNA, 200 bp, Digitaria sanguinalis
atttatcctctaactgcataataaaagatagaaccatcagatctagaatgaaaaagggttatgcaaggacatacaagagacctacaatcaagaaactaaaacaaaacttactggaagattcagcttctatctattaagatgctaaagtgaaagattctaaattttagcacatgaatacaacttaattttacataataaac

SEQ ID NO: 2505 - DNA, 200 bp, Digitaria sanguinalis
tttattatgcagttagaggataaataccaggaatacaagctgaacttttaccatgggaaaaataaggacttcccatccaagttgctgagagacataattgaggtcagttttagatttctttagtcgtattaattttaaactgtttgcttattttaacaatttttttgtaggcaaatcttgcatatggttcagagaaggaa

SEQ ID NO: 2506 - DNA, 200 bp, Digitaria sanguinalis
ttccttctctgaaccatatgcaagatttgcctacaaaaaaattgttaaaataagcaaacagtttaaaattaatacgactaaagaaatctaaaactgacctcaattatgtctctcagcaacttggatgggaagtccttatttttcccatggtaaaagttcagcttgtattcctggtatttatcctctaactgcataataaa

SEQ ID NO: 2507 - DNA, 200 bp, Digitaria sanguinalis
ttttcaggtttgtttgtttcgattttccgattgtgttttttgagtcgctgttgcttgatttctgctgctgttactgctggttgactcttctagtgtgttgattgagatttgttagtttgattcgacttcgattttggaatcggatttttgaacttggagttgtaagtgttttgaagcgtgtttttcggcgttttagttgc

SEQ ID NO: 2508 - DNA, 200 bp, Digitaria sanguinalis
gcaactaaaacgccgaaaaacacgcttcaaaacacttacaactccaagttcaaaaatccgattccaaaatcgaagtcgaatcaaactaacaaatctcaatcaacacactagaagagtcaaccagcagtaacagcagcagaaatcaagcaacagcgactcaaaaaacacaatcggaaaatcgaaacaaacaaacctgaaaa

SEQ ID NO: 2509 - DNA, 200 bp, Digitaria sanguinalis
gcgtgtttttcggcgttttagttgcgtttttcttatggatccgattcttttatatgaatgcggcgtttggcgctgagcaacatgaattggaataaacttgtggtattttgctctttttctatatattagtctaattcaacttcgattatggaatctgatttttgaatttggagtatatgtagtatatttaaacatgtttt

SEQ ID NO: 2510 - DNA, 200 bp, Digitaria sanguinalis
aaaacatgtttaaatatactacatatactccaaattcaaaaatcagattccataatcgaagttgaattagactaatatatagaaaaagagcaaaataccacaagtttattccaattcatgttgctcagcgccaaacgccgcattcatataaaagaatcggatccataagaaaaacgcaactaaaacgccgaaaaacacgc

SEQ ID NO: 2511 - DNA, 200 bp, Digitaria sanguinalis
tatgtagtatatttaaacatgtttttcggtgttatcattgtgtattttttatggatcctgtgcatcggagatgcgtttatatgaatactgtgtttggtgctgagcaacataaattggattatacttgtcgaaaataattctcgtaataaggttcaaggtatctagaagtctacctgaagtgatatagtggaccatgcgga

SEQ ID NO: 2512 - DNA, 200 bp, Digitaria sanguinalis
tccgcatggtccactatatcacttcaggtagacttctagataccttgaaccttattacgagaattattttcgacaagtataatccaatttatgttgctcagcaccaaacacagtattcatataaacgcatctccgatgcacaggatccataaaaaatacacaatgataacaccgaaaaacatgtttaaatatactacata

SEQ ID NO: 2513 - DNA, 200 bp, Digitaria sanguinalis
gaagtgatatagtggaccatgcggatttgattctttgagttgtttttcttcaagtcaaagatcctgttatatttaattatttcttttgatttatgaaatgagtaattaagcaagtggtatgctcaattcgttgaaaatattatgtattgaaaaggatttgaaggttacgaactggattttcaactcgaatgagttttttt

SEQ ID NO: 2514 - DNA, 200 bp, Digitaria sanguinalis
aaaaaaactcattcgagttgaaaatccagttcgtaaccttcaaatccttttcaatacataatattttcaacgaattgagcataccacttgcttaattactcatttcataaatcaaaagaaataattaaatataacaggatctttgacttgaagaaaaacaactcaaagaatcaaatccgcatggtccactatatcacttc

SEQ ID NO: 2515 - DNA, 200 bp, Digitaria sanguinalis
attttcaactcgaatgagtttttttttgtgcagaatgttggagacacagaggaggcagccgttagcagtaggggttactcgtgggaatgatttcaccaatggtgtgcttacgatgagaagccctgctacaatatcagaagtagatcaattttgccgtgctcttggaggaaagagaccgatccacagtatattaattgcaa

SEQ ID NO: 2516 - DNA, 200 bp, Digitaria sanguinalis
ttgcaattaatatactgtggatcggtctctttcctccaagagcacggcaaaattgatctacttctgatattgtagcagggcttctcatcgtaagcacaccattggtgaaatcattcccacgagtaacccctactgctaacggctgcctcctctgtgtctccaacattctgcacaaaaaaaaactcattcgagttgaaaat

SEQ ID NO: 2517 - DNA, 200 bp, Digitaria sanguinalis
ccgatccacagtatattaattgcaaacaatggaatggcagctgtcaagtttatacgaagtgttaggacatgggcttatgaaacttttggcactgaaaaggctatcttgttggtggccatggcaactccagaagacatgaggatcaatgcagagcatattagaatagctgatcagtttgtggaagttcctggggggacaaa

SEQ ID NO: 2518 - DNA, 200 bp, Digitaria sanguinalis
tttgtccccccaggaacttccacaaactgatcagctattctaatatgctctgcattgatcctcatgtcttctggagttgccatggccaccaacaagatagccttttcagtgccaaaagtttcataagcccatgtcctaacacttcgtataaacttgacagctgccattccattgtttgcaattaatatactgtggatcgg

SEQ ID NO: 2519 - DNA, 200 bp, Digitaria sanguinalis
ttgtggaagttcctggggggacaaacaataacaattatgccaatgtgcaactcattgttgaggtgtgtaagttcataaccttttagcatattggatagcttatgttgtgttagtctaaagttcgataattctaagcatataatgatattaaatgtgtttaaggatttctcagtaataggaatttgtaaatcttttctgtc

SEQ ID NO: 2520 - DNA, 200 bp, Digitaria sanguinalis
gacagaaaagatttacaaattcctattactgagaaatccttaaacacatttaatatcattatatgcttagaattatcgaactttagactaacacaacataagctatccaatatgctaaaaggttatgaacttacacacctcaacaatgagttgcacattggcataattgttattgtttgtccccccaggaacttccacaa

SEQ ID NO: 2521 - DNA, 200 bp, Digitaria sanguinalis
taggaatttgtaaatcttttctgtcaatgggttttacagaaattcataaattataatgtaatctagaagctttgaaattgtatttttgcacatctcagaagattatgaagtaataggctggtatacagtgaatttcattattgcaagatattgttgttatgtgctcactcaagagcattcttttcaatttggcaatgtga

SEQ ID NO: 2522 - DNA, 200 bp, Digitaria sanguinalis
tcacattgccaaattgaaaagaatgctcttgagtgagcacataacaacaatatcttgcaataatgaaattcactgtataccagcctattacttcataatcttctgagatgtgcaaaaatacaatttcaaagcttctagattacattataatttatgaatttctgtaaaacccattgacagaaaagatttacaaattccta

SEQ ID NO: 2523 - DNA, 200 bp, Digitaria sanguinalis
cattcttttcaatttggcaatgtgaaaaggttcagttagaaatatcacttgttacccttgttgtttgcataactaagtttgattttgtgtccagatggcagaggtcacccatgttgatgcagtttggcctggttggggacatgcatctgaaaacccagagcttccagatgcactaactgcaaagggaatcgtatttcttg

SEQ ID NO: 2524 - DNA, 200 bp, Digitaria sanguinalis
caagaaatacgattccctttgcagttagtgcatctggaagctctgggttttcagatgcatgtccccaaccaggccaaactgcatcaacatgggtgacctctgccatctggacacaaaatcaaacttagttatgcaaacaacaagggtaacaagtgatatttctaactgaaccttttcacattgccaaattgaaaagaatg

SEQ ID NO: 2525 - DNA, 200 bp, Digitaria sanguinalis
actgcaaagggaatcgtatttcttgggcccccagctgcgtccatgggagctttgggtgataaaattggatcctctttgattgcgcaagcagcagatgttcctactcttccatggagtggctctcatgtaagtaatgctcttctcaagctgttctttcattttctgtagtcattccaatctaagatatcatgatcttcctt

SEQ ID NO: 2526 - DNA, 200 bp, Digitaria sanguinalis
aaggaagatcatgatatcttagattggaatgactacagaaaatgaaagaacagcttgagaagagcattacttacatgagagccactccatggaagagtaggaacatctgctgcttgcgcaatcaaagaggatccaattttatcacccaaagctcccatggacgcagctgggggcccaagaaatacgattccctttgcagt

SEQ ID NO: 2527 - DNA, 200 bp, Digitaria sanguinalis
aatctaagatatcatgatcttccttataggtgaaaattcctccagaaagttgtttgattaccatccccgatgacatatatagagaagcatgtgttcacacaacagaggaagctattgcaagctgccaagttgttggttaccctgctatgataaaggcatcatggggcggtggtggtaaaggcataagaaaggtttggctt

SEQ ID NO: 2528 - DNA, 200 bp, Digitaria sanguinalis
aagccaaacctttcttatgcctttaccaccaccgccccatgatgcctttatcatagcagggtaaccaacaacttggcagcttgcaatagcttcctctgttgtgtgaacacatgcttctctatatatgtcatcggggatggtaatcaaacaactttctggaggaattttcacctataaggaagatcatgatatcttagatt

SEQ ID NO: 2529 - DNA, 200 bp, Digitaria sanguinalis
taaaggcataagaaaggtttggcttcgatataacaaatttccgagtgtagtgttcaagtctgtagtgtacgatggctgagttttgttttcttggattatctaggttcataatgatgatgaagttagggcattgttcaagcaagtccagggtgaagttcccggttcacccatatttataatgaaggtcgcttcacaggtta

SEQ ID NO: 2530 - DNA, 200 bp, Digitaria sanguinalis
taacctgtgaagcgaccttcattataaatatgggtgaaccgggaacttcaccctggacttgcttgaacaatgccctaacttcatcatcattatgaacctagataatccaagaaaacaaaactcagccatcgtacactacagacttgaacactacactcggaaatttgttatatcgaagccaaacctttcttatgccttta

SEQ ID NO: 2531 - DNA, 200 bp, Digitaria sanguinalis
ataatgaaggtcgcttcacaggttaggatattatctagcttctaatttgatacaagagattttactttgtgattcttgacgcgtgaatcgaattctgatgatctatttgattttccttatgtagagtcgacatttagaagtccaattgctctgcgatcaatatggaaatgtagcagctttgcatagccgtgattgtagtg

SEQ ID NO: 2532 - DNA, 200 bp, Digitaria sanguinalis
cactacaatcacggctatgcaaagctgctacatttccatattgatcgcagagcaattggacttctaaatgtcgactctacataaggaaaatcaaatagatcatcagaattcgattcacgcgtcaagaatcacaaagtaaaatctcttgtatcaaattagaagctagataatatcctaacctgtgaagcgaccttcattat

SEQ ID NO: 2533 - DNA, 200 bp, Digitaria sanguinalis
gctttgcatagccgtgattgtagtgttcaaaggcggcatcaaaaggcatgtttatttctctcaagtaattttgattttgtctgcttagtgaaattgaccatgaaagtataagcttagtgtgaagagcctgaggctctgaccacatgcatgttgagaatgagccagtgacttttaatcagtggctcaaccattaatttctc

SEQ ID NO: 2534 - DNA, 200 bp, Digitaria sanguinalis
gagaaattaatggttgagccactgattaaaagtcactggctcattctcaacatgcatgtggtcagagcctcaggctcttcacactaagcttatactttcatggtcaatttcactaagcagacaaaatcaaaattacttgagagaaataaacatgccttttgatgccgcctttgaacactacaatcacggctatgcaaagc

SEQ ID NO: 2535 - DNA, 200 bp, Digitaria sanguinalis
tcagtggctcaaccattaatttctccccttccaaatttcaactgtttgtacatctatctagtatctactacatgggttatgcatttcaaaaaaggcctaacttgtgttgagatgtgaaacagataattgaggagggtccaattaccgttgcaccattggtgactgtaaaaaaactagagcaggcagctcgaaggttagcg

SEQ ID NO: 2536 - DNA, 200 bp, Digitaria sanguinalis
cgctaaccttcgagctgcctgctctagtttttttacagtcaccaatggtgcaacggtaattggaccctcctcaattatctgtttcacatctcaacacaagttaggccttttttgaaatgcataacccatgtagtagatactagatagatgtacaaacagttgaaatttggaaggggagaaattaatggttgagccactga

SEQ ID NO: 2537 - DNA, 200 bp, Digitaria sanguinalis
agagcaggcagctcgaaggttagcgaaatctgtgaattatgtgggcgctgctactgttgagtatttgtacagtatggaaactggcgagtactattttctagagctcaaccctcggttacaggtataaatgaatatagtttgtagggatgtgaagttgttatgctctatagtagtaatgatatctaaaatgcttaaatttt

SEQ ID NO: 2538 - DNA, 200 bp, Digitaria sanguinalis
aaaatttaagcattttagatatcattactactatagagcataacaacttcacatccctacaaactatattcatttatacctgtaaccgagggttgagctctagaaaatagtactcgccagtttccatactgtacaaatactcaacagtagcagcgcccacataattcacagatttcgctaaccttcgagctgcctgctct

SEQ ID NO: 2539 - DNA, 200 bp, Digitaria sanguinalis
atgatatctaaaatgcttaaattttatgttgctcaattgatgacaattggataaaccgtattcacttgggaaaaaccatcctgaatatagttcgtacctcattcaccttgcgtactactgatattgatcctatgaatctgttttttaaaatatctttgtttctgtaataaattgttctttgacttttctaatgatcttta

SEQ ID NO: 2540 - DNA, 200 bp, Digitaria sanguinalis
taaagatcattagaaaagtcaaagaacaatttattacagaaacaaagatattttaaaaaacagattcataggatcaatatcagtagtacgcaaggtgaatgaggtacgaactatattcaggatggtttttcccaagtgaatacggtttatccaattgtcatcaattgagcaacataaaatttaagcattttagatatcat

SEQ ID NO: 2541 - DNA, 200 bp, Digitaria sanguinalis
tctttgacttttctaatgatctttaatctacatcctaatctggatgtaggtggagcatcctgtcacagagtggattgctgaaataaatttgcctgctgcccaagtagctgttgggatgggaattcctctgtggcaaattcctggtatgaccgcaaaagttggaaattcgcattctcttgctcattagacatgtttctttg

SEQ ID NO: 2542 - DNA, 200 bp, Digitaria sanguinalis
caaagaaacatgtctaatgagcaagagaatgcgaatttccaacttttgcggtcataccaggaatttgccacagaggaattcccatcccaacagctacttgggcagcaggcaaatttatttcagcaatccactctgtgacaggatgctccacctacatccagattaggatgtagattaaagatcattagaaaagtcaaaga

SEQ ID NO: 2543 - DNA, 200 bp, Digitaria sanguinalis
cttgctcattagacatgtttctttgacattctgttcatttttattcagagattaggcgattttatggaatggaacatggtggaggatatgatgcttggaggaaaacttcagtggctgctacgccttttgattttgacaaggtagactctacaaagccaaaaggtcattgtgtagctgtacgtgtgacaagtgaggatcca

SEQ ID NO: 2544 - DNA, 200 bp, Digitaria sanguinalis
tggatcctcacttgtcacacgtacagctacacaatgaccttttggctttgtagagtctaccttgtcaaaatcaaaaggcgtagcagccactgaagttttcctccaagcatcatatcctccaccatgttccattccataaaatcgcctaatctctgaataaaaatgaacagaatgtcaaagaaacatgtctaatgagcaag

SEQ ID NO: 2545 - DNA, 200 bp, Digitaria sanguinalis
tgtacgtgtgacaagtgaggatccagatgacggtttcaagcctactagtggaaaagtactggtaaggttttcaggttgactattctaatttgaatttccttctattccaaaattccttatcctgtaatgaacttgtacttttattgtcttgcacaggagctgagttttaaaagcaagccaaatgtgtgggcttatttctc

SEQ ID NO: 2546 - DNA, 200 bp, Digitaria sanguinalis
gagaaataagcccacacatttggcttgcttttaaaactcagctcctgtgcaagacaataaaagtacaagttcattacaggataaggaattttggaatagaaggaaattcaaattagaatagtcaacctgaaaaccttaccagtacttttccactagtaggcttgaaaccgtcatctggatcctcacttgtcacacgtaca

SEQ ID NO: 2547 - DNA, 200 bp, Digitaria sanguinalis
agccaaatgtgtgggcttatttctctgtgaaggtgactttttgctgctctctttctttggaacatgtttatgttgacacaattggtttctgacttaataacttcattctgatttgtagtctggtggaggcattcatgaattctcagattcacaatttggtaagtaataattgctaaataatcacacttcatggataataa

SEQ ID NO: 2548 - DNA, 200 bp, Digitaria sanguinalis
ttattatccatgaagtgtgattatttagcaattattacttaccaaattgtgaatctgagaattcatgaatgcctccaccagactacaaatcagaatgaagttattaagtcagaaaccaattgtgtcaacataaacatgttccaaagaaagagagcagcaaaaagtcaccttcacagagaaataagcccacacatttggct

SEQ ID NO: 2549 - DNA, 200 bp, Digitaria sanguinalis
aataatcacacttcatggataataatgaaaagaagtttgtgagatgagttatccaatctgctgcaaattaatggttcttttttatcttcttgtgacattttttttaacaaaagctacagtctgcttttcagtttagtcttttccgtttgttacatttgctatcgaaagcactcatgattgtcgtaatctttccttaggac

SEQ ID NO: 2550 - DNA, 200 bp, Digitaria sanguinalis
gtcctaaggaaagattacgacaatcatgagtgctttcgatagcaaatgtaacaaacggaaaagactaaactgaaaagcagactgtagcttttgttaaaaaaaatgtcacaagaagataaaaaagaaccattaatttgcagcagattggataactcatctcacaaacttcttttcattattatccatgaagtgtgattatt

SEQ ID NO: 2551 - DNA, 200 bp, Digitaria sanguinalis
gattgtcgtaatctttccttaggacatgtttttgcatttggggagtccagagctttggcaatagctaatatggttcttgggctgaaggaaatacagataagaggagaaatccgcaccaatgttgactactctgttgaccttttacatgtaaactatcttagctgttgatgttccctttatacatcatgtaaactttcacg

SEQ ID NO: 2552 - DNA, 200 bp, Digitaria sanguinalis
cgtgaaagtttacatgatgtataaagggaacatcaacagctaagatagtttacatgtaaaaggtcaacagagtagtcaacattggtgcggatttctcctcttatctgtatttccttcagcccaagaaccatattagctattgccaaagctctggactccccaaatgcaaaaacatgtcctaaggaaagattacgacaatc

SEQ ID NO: 2553 - DNA, 200 bp, Digitaria sanguinalis
tttatacatcatgtaaactttcacgaggaacatgaacacgagttgacatgctatgcaggcttcagattatagggaaaataaaattcacacaggttggttggacagtagaatagctatgagggttagagcagaaagacctccttggtacctctctgttgttggaggggcactatatgtaagttgtcacgatttcacatgag

SEQ ID NO: 2554 - DNA, 200 bp, Digitaria sanguinalis
ctcatgtgaaatcgtgacaacttacatatagtgcccctccaacaacagagaggtaccaaggaggtctttctgctctaaccctcatagctattctactgtccaaccaacctgtgtgaattttattttccctataatctgaagcctgcatagcatgtcaactcgtgttcatgttcctcgtgaaagtttacatgatgtataaa

SEQ ID NO: 2555 - DNA, 200 bp, Digitaria sanguinalis
gtaagttgtcacgatttcacatgagaggatgactgtatacttttggaatgctttattatgtctttcagaacttgccacttaagtgttcaattttttgtttgcaccagaaagcatctgctagcagcgcagctatggtttctgattatgttggttaccttgaaaagggccaaatccctcccaaggtacatcaaaagtatatt

SEQ ID NO: 2556 - DNA, 200 bp, Digitaria sanguinalis
aatatacttttgatgtaccttgggagggatttggcccttttcaaggtaaccaacataatcagaaaccatagctgcgctgctagcagatgctttctggtgcaaacaaaaaattgaacacttaagtggcaagttctgaaagacataataaagcattccaaaagtatacagtcatcctctcatgtgaaatcgtgacaacttac

SEQ ID NO: 2557 - DNA, 200 bp, Digitaria sanguinalis
tcccaaggtacatcaaaagtatatttgtacaattgtatatgtttcttattcagccgattatgttgatgttgatgttgatgttagttgatcttgttttcagcacatatcacttgtgaactctcaagtttcattgaacatcgaaggaagcaaatatacggtatggtacctttcatattagtatcttaaatgaataaatttta

SEQ ID NO: 2558 - DNA, 200 bp, Digitaria sanguinalis
taaaatttattcatttaagatactaatatgaaaggtaccataccgtatatttgcttccttcgatgttcaatgaaacttgagagttcacaagtgatatgtgctgaaaacaagatcaactaacatcaacatcaacatcaacataatcggctgaataagaaacatatacaattgtacaaatatacttttgatgtaccttggga

SEQ ID NO: 2559 - DNA, 200 bp, Digitaria sanguinalis
tagtatcttaaatgaataaattttagtttggtgatggatgccatttacgtttgtaaaatcattgctagattgacatggttagaggggggccagggagctatagattgaggatgaatggatcggagatagaggcagaaattcatacactgcgtgatggaggtttattgatgcaggcaagttgactcattaaccatggctgt

SEQ ID NO: 2560 - DNA, 200 bp, Digitaria sanguinalis
acagccatggttaatgagtcaacttgcctgcatcaataaacctccatcacgcagtgtatgaatttctgcctctatctccgatccattcatcctcaatctatagctccctggcccccctctaaccatgtcaatctagcaatgattttacaaacgtaaatggcatccatcaccaaactaaaatttattcatttaagatacta

SEQ ID NO: 2561 - DNA, 200 bp, Digitaria sanguinalis
aagttgactcattaaccatggctgttgtaaactaataattttcgtcctttttatcatttaatatttgctttagtcgaccctccatgctttggagaccataacagactctattctgtttcttcacagttagacggaaacagtcatgtaatatatgctgaagaagaagcagccggaactcgccttctaattgacgggaggac

SEQ ID NO: 2562 - DNA, 200 bp, Digitaria sanguinalis
gtcctcccgtcaattagaaggcgagttccggctgcttcttcttcagcatatattacatgactgtttccgtctaactgtgaagaaacagaatagagtctgttatggtctccaaagcatggagggtcgactaaagcaaatattaaatgataaaaaggacgaaaattattagtttacaacagccatggttaatgagtcaactt

SEQ ID NO: 2563 - DNA, 200 bp, Digitaria sanguinalis
ctcgccttctaattgacgggaggacttgcttgctacagaatgatcatgatccgtcaaagttagtggcagagacaccatgcaaacttctgagatatttggtttcagatggtagtcatattgaagctgatgctccatatgcagaggttgaagttatgaagatgtgcatgcctcttctttcacctgcttctggagttgtccat

SEQ ID NO: 2564 - DNA, 200 bp, Digitaria sanguinalis
atggacaactccagaagcaggtgaaagaagaggcatgcacatcttcataacttcaacctctgcatatggagcatcagcttcaatatgactaccatctgaaaccaaatatctcagaagtttgcatggtgtctctgccactaactttgacggatcatgatcattctgtagcaagcaagtcctcccgtcaattagaaggcgag

SEQ ID NO: 2565 - DNA, 200 bp, Digitaria sanguinalis
ttcacctgcttctggagttgtccattttaaaatgtctgaaggtcaagcaatgcaggtgtgtttgatttcacaaacacgtgcttttgggcttgataagtactttttagttttatatgaatagtcagttttgatgtgaatctaagaagttttcatgtaggctggggagctcattgcaaggcttgatcttgatgatccttctg

SEQ ID NO: 2566 - DNA, 200 bp, Digitaria sanguinalis
cagaaggatcatcaagatcaagccttgcaatgagctccccagcctacatgaaaacttcttagattcacatcaaaactgactattcatataaaactaaaaagtacttatcaagcccaaaagcacgtgtttgtgaaatcaaacacacctgcattgcttgaccttcagacattttaaaatggacaactccagaagcaggtgaa

SEQ ID NO: 2567 - DNA, 200 bp, Digitaria sanguinalis
aggcttgatcttgatgatccttctgctgtaagaaaggcagagccttttcatgggagattcccgctacttggctctccgactgctatttctggtaaagttcatcagagatgtgctgcaagtttgaatgcagcccgtatgattcttgctggctatgatcataatattgatgaagtaagttgcaagctggctagtttcaacat

SEQ ID NO: 2568 - DNA, 200 bp, Digitaria sanguinalis
atgttgaaactagccagcttgcaacttacttcatcaatattatgatcatagccagcaagaatcatacgggctgcattcaaacttgcagcacatctctgatgaactttaccagaaatagcagtcggagagccaagtagcgggaatctcccatgaaaaggctctgcctttcttacagcagaaggatcatcaagatcaagcct

SEQ ID NO: 2569 - DNA, 200 bp, Digitaria sanguinalis
gttgcaagctggctagtttcaacatgaacttaattgatgaattaattgttcattctatattttgttgattgtgtaatttcataacaaaataatgaactatgcatttggtttattatactgacaattatttgttgaaatctgatgtaatatctcaatgacatctataggtagtgcaaaacttgctcaattgccttgacagt

SEQ ID NO: 2570 - DNA, 200 bp, Digitaria sanguinalis
actgtcaaggcaattgagcaagttttgcactacctatagatgtcattgagatattacatcagatttcaacaaataattgtcagtataataaaccaaatgcatagttcattattttgttatgaaattacacaatcaacaaaatatagaatgaacaattaattcatcaattaagttcatgttgaaactagccagcttgcaac

SEQ ID NO: 2571 - DNA, 200 bp, Digitaria sanguinalis
aaacttgctcaattgccttgacagtcctgaactccctttccttcagtggcaagagtgcttgtctgttctagcaactcgccttcccaaggatcttagaagcgaggtgaataatttttctgtaattttttcatgaccacatagtcttcttgctcacaatttgatattggcaatttgtatagttggaatcaaaatacacagag

SEQ ID NO: 2572 - DNA, 200 bp, Digitaria sanguinalis
ctctgtgtattttgattccaactatacaaattgccaatatcaaattgtgagcaagaagactatgtggtcatgaaaaaattacagaaaaattattcacctcgcttctaagatccttgggaaggcgagttgctagaacagacaagcactcttgccactgaaggaaagggagttcaggactgtcaaggcaattgagcaagttt

SEQ ID NO: 2573 - DNA, 200 bp, Digitaria sanguinalis
atagttggaatcaaaatacacagagtttgaaggaatttcaagctcccagaacattgacttccctgccaaactgttaaggggtgtcctcgaggtgggttccttattgcatggctctcttggaatttctcattatctgttttttttgctgtttaatgagatgtgtatgcttttcctccaggcacacctgaaatcctgtcctg

SEQ ID NO: 2574 - DNA, 200 bp, Digitaria sanguinalis
caggacaggatttcaggtgtgcctggaggaaaagcatacacatctcattaaacagcaaaaaaaacagataatgagaaattccaagagagccatgcaataaggaacccacctcgaggacaccccttaacagtttggcagggaagtcaatgttctgggagcttgaaattccttcaaactctgtgtattttgattccaactat

SEQ ID NO: 2575 - DNA, 200 bp, Digitaria sanguinalis
caggcacacctgaaatcctgtcctgagaaagaaaaaggagccctggaaaggcttgttgaacctttgatgagtcttgtaaagtcttatgagggaggacgtgagagtcatgctcgagtgatcgtccaatcactttttgaagagtatttatctgtagaagaattatttagtgacaacatccaggttagcttcttcctatcaaa

SEQ ID NO: 2576 - DNA, 200 bp, Digitaria sanguinalis
tttgataggaagaagctaacctggatgttgtcactaaataattcttctacagataaatactcttcaaaaagtgattggacgatcactcgagcatgactctcacgtcctccctcataagactttacaagactcatcaaaggttcaacaagcctttccagggctcctttttctttctcaggacaggatttcaggtgtgcctg

SEQ ID NO: 2577 - DNA, 200 bp, Digitaria sanguinalis
tccaggttagcttcttcctatcaaacataatatggaattattttggattctgaaagtcttccctctttggcatcttttagaaaattaagcataatactaggtactatatccattattctttataatcatgaaatttaatttttacagaagaaaagtggaatttctatatatatttaaaccaagctggcaagctttgaatt

SEQ ID NO: 2578 - DNA, 200 bp, Digitaria sanguinalis
aattcaaagcttgccagcttggtttaaatatatatagaaattccacttttcttctgtaaaaattaaatttcatgattataaagaataatggatatagtacctagtattatgcttaattttctaaaagatgccaaagagggaagactttcagaatccaaaataattccatattatgtttgataggaagaagctaacctgga

SEQ ID NO: 2579 - DNA, 200 bp, Digitaria sanguinalis
aaaccaagctggcaagctttgaattcaatcctgttgtttattgttttatccaacatgccaaaaatattaggaacttcatgtgactacttgtatcattcttattctgtaattacagtaaagtaacttgtcatatcctaatgttataactcgtaacattcttctttaggctgatgtgattgaacgtctcagacttcaatata

SEQ ID NO: 2580 - DNA, 200 bp, Digitaria sanguinalis
tatattgaagtctgagacgttcaatcacatcagcctaaagaagaatgttacgagttataacattaggatatgacaagttactttactgtaattacagaataagaatgatacaagtagtcacatgaagttcctaatatttttggcatgttggataaaacaataaacaacaggattgaattcaaagcttgccagcttggttt

SEQ ID NO: 2581 - DNA, 200 bp, Digitaria sanguinalis
attgaacgtctcagacttcaatataagaaagaccttttgaagatagtggacattgtcctttctcatcaggtatctgattttcggttttaatttttatctcgggttttctaaaatagaattctgagtttgtggaaataactaccgtatttgttggtttatagggtgttaagagtaaaaataagctgatactacggctcatg

SEQ ID NO: 2582 - DNA, 200 bp, Digitaria sanguinalis
catgagccgtagtatcagcttatttttactcttaacaccctataaaccaacaaatacggtagttatttccacaaactcagaattctattttagaaaacccgagataaaaattaaaaccgaaaatcagatacctgatgagaaaggacaatgtccactatcttcaaaaggtctttcttatattgaagtctgagacgttcaat

SEQ ID NO: 2583 - DNA, 200 bp, Digitaria sanguinalis
aaataagctgatactacggctcatggaacaacttgtttaccccaaccctgctgcatatagggataaactcattcggttctctcagcttaaccacaccagctattccgaggttggcagctatacttggtccatctgtaatttcataaagttgttgctctgtttccttttgttcacaagttcatttttgagagttttccata

SEQ ID NO: 2584 - DNA, 200 bp, Digitaria sanguinalis
tatggaaaactctcaaaaatgaacttgtgaacaaaaggaaacagagcaacaactttatgaaattacagatggaccaagtatagctgccaacctcggaatagctggtgtggttaagctgagagaaccgaatgagtttatccctatatgcagcagggttggggtaaacaagttgttccatgagccgtagtatcagcttattt

SEQ ID NO: 2585 - DNA, 200 bp, Digitaria sanguinalis
agttcatttttgagagttttccataggatggtgactgacaggaagaggattctaatgttttctcttggaggattttttctgtattttcatttcttgtcggtcattgattaattccgtttctggtatcagtatcatcaaaatgttgtctttttctgtatactgatgctgaattatgtgaacagttggcattgaaggcaagt

SEQ ID NO: 2586 - DNA, 200 bp, Digitaria sanguinalis
acttgccttcaatgccaactgttcacataattcagcatcagtatacagaaaaagacaacattttgatgatactgataccagaaacggaattaatcaatgaccgacaagaaatgaaaatacagaaaaaatcctccaagagaaaacattagaatcctcttcctgtcagtcaccatcctatggaaaactctcaaaaatgaact

SEQ ID NO: 2587 - DNA, 200 bp, Digitaria sanguinalis
tgaacagttggcattgaaggcaagtcaactcctagaacaaaccaaactgagtgaactccgttccactattgctagaagcctttcggaattggagatgtttaccgaggatggtgaaaatatggatactcccaaaaggaaaagtgccattaatgaacgtatggaggatcttgtgagtgctcctttggctgttgaagatgctt

SEQ ID NO: 2588 - DNA, 200 bp, Digitaria sanguinalis
aagcatcttcaacagccaaaggagcactcacaagatcctccatacgttcattaatggcacttttccttttgggagtatccatattttcaccatcctcggtaaacatctccaattccgaaaggcttctagcaatagtggaacggagttcactcagtttggtttgttctaggagttgacttgccttcaatgccaactgttca

SEQ ID NO: 2589 - DNA, 200 bp, Digitaria sanguinalis
gctcctttggctgttgaagatgctttagtgggtcttttcgagcacagtgatcacacccttcaaaggcgagtggtggaaacttatgttcgtaggctatatcaggtactgtgttgtagaaacttaaaacttttatctggtgatcaaacactagacgaaacttgatcttgatcaactgtttgtctaccgcaccagccctatct

SEQ ID NO: 2590 - DNA, 200 bp, Digitaria sanguinalis
agatagggctggtgcggtagacaaacagttgatcaagatcaagtttcgtctagtgtttgatcaccagataaaagttttaagtttctacaacacagtacctgatatagcctacgaacataagtttccaccactcgcctttgaagggtgtgatcactgtgctcgaaaagacccactaaagcatcttcaacagccaaaggagc

SEQ ID NO: 2591 - DNA, 200 bp, Digitaria sanguinalis
tttgtctaccgcaccagccctatctggtcaaaggtagtgtcaggatgcagtggcatagatttggtcttattgctacatgggaattcttgggagagcatatcgggagaaagaatggatctgaaggtcaaatgtcagatgaaccagaggctaaaaaacagtctaataagagatggggagcaatggttatcatcagatctctg

SEQ ID NO: 2592 - DNA, 200 bp, Digitaria sanguinalis
cagagatctgatgataaccattgctccccatctcttattagactgttttttagcctctggttcatctgacatttgaccttcagatccattctttctcccgatatgctctcccaagaattcccatgtagcaataagaccaaatctatgccactgcatcctgacactacctttgaccagatagggctggtgcggtagacaaa

SEQ ID NO: 2593 - DNA, 200 bp, Digitaria sanguinalis
agcaatggttatcatcagatctctgcagtttttgccttcagttattggtgctgcattaagggaaacaaatcaaagccttaatgagtccattccaagtggattagtaaaatcagcgagctttggtaatatgatgcacatagcattggtaggcatcaataatcagatgagcttactacaggataggtaacttccttcggtac

SEQ ID NO: 2594 - DNA, 200 bp, Digitaria sanguinalis
gtaccgaaggaagttacctatcctgtagtaagctcatctgattattgatgcctaccaatgctatgtgcatcatattaccaaagctcgctgattttactaatccacttggaatggactcattaaggctttgatttgtttcccttaatgcagcaccaataactgaaggcaaaaactgcagagatctgatgataaccattgct

SEQ ID NO: 2595 - DNA, 200 bp, Digitaria sanguinalis
caggataggtaacttccttcggtactataatataagcgtttattttaatcataaaaattagtagcattttacattctattattcattgtaagatctcaagtcttcttaatcatttctgcatttgaaaccttgatagatctggatagattccttatttttgtttaaaatttatgatagagttacctggtctcgaaccctta

SEQ ID NO: 2596 - DNA, 200 bp, Digitaria sanguinalis
taagggttcgagaccaggtaactctatcataaattttaaacaaaaataaggaatctatccagatctatcaaggtttcaaatgcagaaatgattaagaagacttgagatcttacaatgaataatagaatgtaaaatgctactaatttttatgattaaaataaacgcttatattatagtaccgaaggaagttacctatcctg

SEQ ID NO: 2597 - DNA, 200 bp, Digitaria sanguinalis
agagttacctggtctcgaacccttaaaacatgcacatatattggcttgccaaacataagttattttgcgttgtcaatttcgattattgacggtcagcttgttaatgctcctaactggcaccatctatgacattttgcagtggtgatgaggatcaggcacaagagagaattaacaagttagccaaaattctcaaagaacag

SEQ ID NO: 2598 - DNA, 200 bp, Digitaria sanguinalis
ctgttctttgagaattttggctaacttgttaattctctcttgtgcctgatcctcatcaccactgcaaaatgtcatagatggtgccagttaggagcattaacaagctgaccgtcaataatcgaaattgacaacgcaaaataacttatgtttggcaagccaatatatgtgcatgttttaagggttcgagaccaggtaactct

SEQ ID NO: 2599 - DNA, 200 bp, Digitaria sanguinalis
gttagccaaaattctcaaagaacaggaactaggttccagtttgagcttgtcaggcgttggagttattagctgtatcatacagagggatgaagggagagcccctatgaggcactcctttcactggtcagaggaaaagctttattatgaggaagaacctctattgcgacatttggaacctccactatccatctaccttgaac

SEQ ID NO: 2600 - DNA, 200 bp, Digitaria sanguinalis
gttcaaggtagatggatagtggaggttccaaatgtcgcaatagaggttcttcctcataataaagcttttcctctgaccagtgaaaggagtgcctcataggggctctcccttcatccctctgtatgatacagctaataactccaacgcctgacaagctcaaactggaacctagttcctgttctttgagaattttggctaac

SEQ ID NO: 2601 - DNA, 200 bp, Digitaria sanguinalis
cctccactatccatctaccttgaactggtttgtcacctatcgcagtgtttcaatacatttttttggcagaaacctttattgagcccctgaacttaccagttttattctcaagttattatttgactacattaaatacttaattactattgattccacattatgaccttgcaatataattacaagtgttacgttttattgat

SEQ ID NO: 2602 - DNA, 200 bp, Digitaria sanguinalis
atcaataaaacgtaacacttgtaattatattgcaaggtcataatgtggaatcaatagtaattaagtatttaatgtagtcaaataataacttgagaataaaactggtaagttcaggggctcaataaaggtttctgccaaaaaaatgtattgaaacactgcgataggtgacaaaccagttcaaggtagatggatagtggagg

SEQ ID NO: 2603 - DNA, 200 bp, Digitaria sanguinalis
attacaagtgttacgttttattgataaaattataactgttgctattttgttttacatatatcaaggactgcactatagtaaaaaaatgaggactcgataggattggaaagttcaggggcttactaattgtttgagcggaaaaaaatatatataaatgtgaaattggataattctatatcattcatctgaagcttattatg

SEQ ID NO: 2604 - DNA, 200 bp, Digitaria sanguinalis
cataataagcttcagatgaatgatatagaattatccaatttcacatttatatatatttttttccgctcaaacaattagtaagcccctgaactttccaatcctatcgagtcctcatttttttactatagtgcagtccttgatatatgtaaaacaaaatagcaacagttataattttatcaataaaacgtaacacttgtaat

SEQ ID NO: 2605 - DNA, 200 bp, Digitaria sanguinalis
tatcattcatctgaagcttattatggcctttttttgatccaggacaaacttaaaggctatgacaatagacaatatactcagtcaagggacagacaatggcacatgtacactgttgtagacaaaccagttccaatccagaggatgtttctaagaacccttgtgagacagcccacaagtacttcatatcaaggtcttggcgc

SEQ ID NO: 2606 - DNA, 200 bp, Digitaria sanguinalis
gcgccaagaccttgatatgaagtacttgtgggctgtctcacaagggttcttagaaacatcctctggattggaactggtttgtctacaacagtgtacatgtgccattgtctgtcccttgactgagtatattgtctattgtcatagcctttaagtttgtcctggatcaaaaaaaggccataataagcttcagatgaatgata

SEQ ID NO: 2607 - DNA, 200 bp, Digitaria sanguinalis
gtacttcatatcaaggtcttggcgccgaagcacccaatgtgcagtgggccatgtcctttacgtcaaagagcattttgaggtccttagtagctgcaatggaggaactggagcttcacgtgcacactgtcaaatctgaccatgctcatatgtacctctgcatattgagggagcaacggatagaagatcttgttccatacacg

SEQ ID NO: 2608 - DNA, 200 bp, Digitaria sanguinalis
cgtgtatggaacaagatcttctatccgttgctccctcaatatgcagaggtacatatgagcatggtcagatttgacagtgtgcacgtgaagctccagttcctccattgcagctactaaggacctcaaaatgctctttgacgtaaaggacatggcccactgcacattgggtgcttcggcgccaagaccttgatatgaagtac

SEQ ID NO: 2609 - DNA, 200 bp, Digitaria sanguinalis
gatagaagatcttgttccatacacgaagtaattatatcaatctttatgatttattgtgtacttggcaccataactttatgtgtactcactatgagactccatctccaggaaaaccgatgtagatgccaaccaagaagaagctgcggtagcaagaatcttggaagaactagcgaggaagatacatgcgtcggttggagtca

SEQ ID NO: 2610 - DNA, 200 bp, Digitaria sanguinalis
tgactccaaccgacgcatgtatcttcctcgctagttcttccaagattcttgctaccgcagcttcttcttggttggcatctacatcggttttcctggagatggagtctcatagtgagtacacataaagttatggtgccaagtacacaataaatcataaagattgatataattacttcgtgtatggaacaagatcttctatc

SEQ ID NO: 2611 - DNA, 200 bp, Digitaria sanguinalis
aagatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatgtaagtatctgcgcatcttatttcaagaaaatgtctttcccttccatgcattc

SEQ ID NO: 2612 - DNA, 200 bp, Digitaria sanguinalis
gaatgcatggaagggaaagacattttcttgaaataagatgcgcagatacttacatgcacagcacaggtatgcccagtcacatttgttgtgacaactctccaagcaccatttgcctgtccagatgatgtcatccatagcttcacttcccactcgcaaacatttaacctatgcattctgactccaaccgacgcatgtatctt

SEQ ID NO: 2613 - DNA, 200 bp, Digitaria sanguinalis
aaatgtctttcccttccatgcattccttattagtcgacttagtaatggggaatgtcgagaagtgttggatggttaccaatgtgagtaccatcactgtttagattaaaattgaccattgctttagcaatacaataatgaatctaattgtggcatgggaggcttttctatgtgtgatccatggaaaaacttgtatatagttc

SEQ ID NO: 2614 - DNA, 200 bp, Digitaria sanguinalis
gaactatatacaagtttttccatggatcacacatagaaaagcctcccatgccacaattagattcattattgtattgctaaagcaatggtcaattttaatctaaacagtgatggtactcacattggtaaccatccaacacttctcgacattccccattactaagtcgactaataaggaatgcatggaagggaaagacattt

SEQ ID NO: 2615 - DNA, 200 bp, Digitaria sanguinalis
ccatggaaaaacttgtatatagttccttagtaggtttgagttgttttcatttttcttttatcacattgtaattgtattggtgattgatacgaaaattagatatatcgggaacttggggacgagagcaaacatgaagtggtgtaccattcaatctctccaagaggcccactgcatagcatgccagtgaatgctgtttatca

SEQ ID NO: 2616 - DNA, 200 bp, Digitaria sanguinalis
tgataaacagcattcactggcatgctatgcagtgggcctcttggagagattgaatggtacaccacttcatgtttgctctcgtccccaagttcccgatatatctaattttcgtatcaatcaccaatacaattacaatgtgataaaagaaaaatgaaaacaactcaaacctactaaggaactatatacaagtttttccatgg

SEQ ID NO: 2617 - DNA, 200 bp, Digitaria sanguinalis
gcatgccagtgaatgctgtttatcagcccttgggagttctcgatcgaaaacgtttgttggcaaggaagagcaacaccacttactgctatgattttccactggttagtatttctataatcattaatcaaacatcagtttttttattggggataattaaaatcaaataatttttcctggcctcatccttttcaggcgttcga

SEQ ID NO: 2618 - DNA, 200 bp, Digitaria sanguinalis
tcgaacgcctgaaaaggatgaggccaggaaaaattatttgattttaattatccccaataaaaaaactgatgtttgattaatgattatagaaatactaaccagtggaaaatcatagcagtaagtggtgttgctcttccttgccaacaaacgttttcgatcgagaactcccaagggctgataaacagcattcactggcatgc

SEQ ID NO: 2619 - DNA, 200 bp, Digitaria sanguinalis
ggcctcatccttttcaggcgttcgagacagccatcgaacaattatgggaatctcaatcaccagggactgaaagaaacaaagaaaaagtcctaaaagtctcggagcttgtttttgccgatcagaaaggtacctggggaactccacttgttcatgcagaacggccagctgggcttaacgacgtgggcatggtagcatggtgc

SEQ ID NO: 2620 - DNA, 200 bp, Digitaria sanguinalis
gcaccatgctaccatgcccacgtcgttaagcccagctggccgttctgcatgaacaagtggagttccccaggtacctttctgatcggcaaaaacaagctccgagacttttaggactttttctttgtttctttcagtccctggtgattgagattcccataattgttcgatggctgtctcgaacgcctgaaaaggatgaggcc

SEQ ID NO: 2621 - DNA, 200 bp, Euphorbia heterophylla
aaaatatctttgtttctgtaataaattgttctttgacttttctaatgatctttaatctacatcctaatctggatgtaggtggagcatcccgtcacagagtggattgctgaaataaatttgcctgctgcccaagtagctgttgggatgggaattcctctgtggcaaattcctggtatgaccgcaaaagttggaaattcaca

SEQ ID NO: 2622 - DNA, 200 bp, Euphorbia heterophylla
tgtgaatttccaacttttgcggtcataccaggaatttgccacagaggaattcccatcccaacagctacttgggcagcaggcaaatttatttcagcaatccactctgtgacgggatgctccacctacatccagattaggatgtagattaaagatcattagaaaagtcaaagaacaatttattacagaaacaaagatatttt

SEQ ID NO: 2623 - DNA, 200 bp, Euphorbia heterophylla
tgaccgcaaaagttggaaattcacattttcttgctcattagacatgtttctttgacattctgttgatttttaatcagagattaggcgattttatggaatggaacatggtggaggatatgatgcttggaggaaaacttcagtggctgctacgccttttgattttgacaaggtagactctacaaagccaaaaggtcattgtg

SEQ ID NO: 2624 - DNA, 200 bp, Euphorbia heterophylla
cacaatgaccttttggctttgtagagtctaccttgtcaaaatcaaaaggcgtagcagccactgaagttttcctccaagcatcatatcctccaccatgttccattccataaaatcgcctaatctctgattaaaaatcaacagaatgtcaaagaaacatgtctaatgagcaagaaaatgtgaatttccaacttttgcggtca

SEQ ID NO: 2625 - DNA, 200 bp, Euphorbia heterophylla
tctacaaagccaaaaggtcattgtgtagctgtacgtgtgacaagtgaggatccagatgacggctttaagcctactagtggaaaagtactggtaaggttttcaggttgactattctaatttgaatttccttctattccaaaattccttatcctgtaatgaacttgtacttttattgtcttgcacaggagctgagttttaaa

SEQ ID NO: 2626 - DNA, 200 bp, Euphorbia heterophylla
tttaaaactcagctcctgtgcaagacaataaaagtacaagttcattacaggataaggaattttggaatagaaggaaattcaaattagaatagtcaacctgaaaaccttaccagtacttttccactagtaggcttaaagccgtcatctggatcctcacttgtcacacgtacagctacacaatgaccttttggctttgtaga

SEQ ID NO: 2627 - DNA, 200 bp, Euphorbia heterophylla
tcttgcacaggagctgagttttaaaagcaagccaaatgtgtgggcttatttctctgtgaaggtgactttttgctgctctctttctttggaacatgtttatgttgacacaattggtttctgacttaataacttcattctgatttgtagtctggtggaggcattcatgaattctcagattcacaatttggtaagtaataatt

SEQ ID NO: 2628 - DNA, 200 bp, Euphorbia heterophylla
aattattacttaccaaattgtgaatctgagaattcatgaatgcctccaccagactacaaatcagaatgaagttattaagtcagaaaccaattgtgtcaacataaacatgttccaaagaaagagagcagcaaaaagtcaccttcacagagaaataagcccacacatttggcttgcttttaaaactcagctcctgtgcaaga

SEQ ID NO: 2629 - DNA, 200 bp, Euphorbia heterophylla
attcacaatttggtaagtaataattgctaaataatcacacttcatggataataatgaaaagaagtttgtgagatgagttatccaatctgctgcaaattaatggttcttttttatcttcttgtgacattttttttaacaaaagctacagtctgcttttcagtttagtcttttccgtttgttacatttgctatcgaaagcac

SEQ ID NO: 2630 - DNA, 200 bp, Euphorbia heterophylla
gtgctttcgatagcaaatgtaacaaacggaaaagactaaactgaaaagcagactgtagcttttgttaaaaaaaatgtcacaagaagataaaaaagaaccattaatttgcagcagattggataactcatctcacaaacttcttttcattattatccatgaagtgtgattatttagcaattattacttaccaaattgtgaat

SEQ ID NO: 2631 - DNA, 200 bp, Euphorbia heterophylla
ttgttacatttgctatcgaaagcactcatgattgtcgtaatctttccttaggacatgtttttgcatttggggagtccagagctttggcaatagctaatatggttcttgggctgaaggaaatacagataagaggagaaatccgcaccaatgttgactactctgttgaccttttacatgtaaactatcttagctgttgatgt

SEQ ID NO: 2632 - DNA, 200 bp, Euphorbia heterophylla
acatcaacagctaagatagtttacatgtaaaaggtcaacagagtagtcaacattggtgcggatttctcctcttatctgtatttccttcagcccaagaaccatattagctattgccaaagctctggactccccaaatgcaaaaacatgtcctaaggaaagattacgacaatcatgagtgctttcgatagcaaatgtaacaa

SEQ ID NO: 2633 - DNA, 200 bp, Euphorbia heterophylla
tgtaaactatcttagctgttgatgttccctttatacatcatgtaaactttcacgaggaacatgaacacgagttgacatgctatgcaggcttcagattatagggaaaataaaattcacacaggttggttggacagtagaatagctatgagggttagagcagaaagacctccttggtacctctctgttgttggaggggcact

SEQ ID NO: 2634 - DNA, 200 bp, Euphorbia heterophylla
agtgcccctccaacaacagagaggtaccaaggaggtctttctgctctaaccctcatagctattctactgtccaaccaacctgtgtgaattttattttccctataatctgaagcctgcatagcatgtcaactcgtgttcatgttcctcgtgaaagtttacatgatgtataaagggaacatcaacagctaagatagtttaca

SEQ ID NO: 2635 - DNA, 200 bp, Euphorbia heterophylla
acctctctgttgttggaggggcactatatgtaagttgtcacgatttcacatgagaggatgactgtatacttttggaatgctttattatgtctttcagaacttgccacttaagtgttcaattttttgtttgcaccagaaagcatctgctagcagcgcagctatggtttctgattatgttggttaccttgaaaagggccaaa

SEQ ID NO: 2636 - DNA, 200 bp, Euphorbia heterophylla
tttggcccttttcaaggtaaccaacataatcagaaaccatagctgcgctgctagcagatgctttctggtgcaaacaaaaaattgaacacttaagtggcaagttctgaaagacataataaagcattccaaaagtatacagtcatcctctcatgtgaaatcgtgacaacttacatatagtgcccctccaacaacagagaggt

SEQ ID NO: 2637 - DNA, 200 bp, Euphorbia heterophylla
atgttagttgatcttgttttcagcacatatcacttgtgaactctcaagtttcattgaacatcgaaggaagcaaatatacggtatggtacctttcatattagtatcttaaatgaataaattttagtttggtgatggatgccatttacgtttgtaaaatcattgctagattgacatggttagaggggggccagggagctata

SEQ ID NO: 2638 - DNA, 200 bp, Euphorbia heterophylla
tatagctccctggcccccctctaaccatgtcaatctagcaatgattttacaaacgtaaatggcatccatcaccaaactaaaatttattcatttaagatactaatatgaaaggtaccataccgtatatttgcttccttcgatgttcaatgaaacttgagagttcacaagtgatatgtgctgaaaacaagatcaactaacat

SEQ ID NO: 2639 - DNA, 200 bp, Euphorbia heterophylla
gttagaggggggccagggagctatagattgaggatgaatggatcggagatagaggcagaaattcatacactgcgtgatggaggtttattgatgcaggcaagttgactcattaaccatggctgttgtaaactaataattttcgtcctttttatcatttaatatttgctttagtcgaccctccatgctttggagaccataac

SEQ ID NO: 2640 - DNA, 200 bp, Euphorbia heterophylla
gttatggtctccaaagcatggagggtcgactaaagcaaatattaaatgataaaaaggacgaaaattattagtttacaacagccatggttaatgagtcaacttgcctgcatcaataaacctccatcacgcagtgtatgaatttctgcctctatctccgatccattcatcctcaatctatagctccctggcccccctctaac

SEQ ID NO: 2641 - DNA, 200 bp, Euphorbia heterophylla
ccctccatgctttggagaccataacagactctattctgtttcttcacagttagacggaaacagtcatgtaatatatgctgaagaagaagcagccggaactcgccttctaattgacgggaggacttgcttgctacagaatgatcatgatccgtcaaagttagtggcagagacgccatgcaaacttctgagatatttggttt

SEQ ID NO: 2642 - DNA, 200 bp, Euphorbia heterophylla
aaaccaaatatctcagaagtttgcatggcgtctctgccactaactttgacggatcatgatcattctgtagcaagcaagtcctcccgtcaattagaaggcgagttccggctgcttcttcttcagcatatattacatgactgtttccgtctaactgtgaagaaacagaatagagtctgttatggtctccaaagcatggaggg

SEQ ID NO: 2643 - DNA, 200 bp, Euphorbia heterophylla
tgcaaacttctgagatatttggtttcagatggtagtcatattgaagctgatgctccatatgcagaggttgaagttatgaagatgtgcatgcctcttctttcacctgcttctggagttgtccattttaaaatgtctgaaggtcaagcaatgcaggtgtgtttgatttcacaaacacatgcttttgggcttgataagtacat

SEQ ID NO: 2644 - DNA, 200 bp, Euphorbia heterophylla
atgtacttatcaagcccaaaagcatgtgtttgtgaaatcaaacacacctgcattgcttgaccttcagacattttaaaatggacaactccagaagcaggtgaaagaagaggcatgcacatcttcataacttcaacctctgcatatggagcatcagcttcaatatgactaccatctgaaaccaaatatctcagaagtttgca

SEQ ID NO: 2645 - DNA, 200 bp, Euphorbia heterophylla
atgcttttgggcttgataagtacattttggttttatatgaatagtcagttttgatgtgaatctaagaagttttcatgtaggctggggagctcattgcaaggcttgatcttgatgatccttctgctgtaagaaaggcagagccttttcatgggagattcccgctacttggctctccgactgctatttctggtaaagttcat

SEQ ID NO: 2646 - DNA, 200 bp, Euphorbia heterophylla
atgaactttaccagaaatagcagtcggagagccaagtagcgggaatctcccatgaaaaggctctgcctttcttacagcagaaggatcatcaagatcaagccttgcaatgagctccccagcctacatgaaaacttcttagattcacatcaaaactgactattcatataaaaccaaaatgtacttatcaagcccaaaagcat

SEQ ID NO: 2647 - DNA, 200 bp, Euphorbia heterophylla
gactgctatttctggtaaagttcatcagagatgtgctgcaagtttgaatgcagcccgtatgattcttgctggctatgatcataatattgatgaagtaagttgcaagctggctagtttcaacatgaacttaattgatgaattaattgttcattctatattttgttgattgtgtaatttcataacaaaataatgaactgtgc

SEQ ID NO: 2648 - DNA, 200 bp, Euphorbia heterophylla
gcacagttcattattttgttatgaaattacacaatcaacaaaatatagaatgaacaattaattcatcaattaagttcatgttgaaactagccagcttgcaacttacttcatcaatattatgatcatagccagcaagaatcatacgggctgcattcaaacttgcagcacatctctgatgaactttaccagaaatagcagtc

SEQ ID NO: 2649 - DNA, 200 bp, Euphorbia heterophylla
ttcataacaaaataatgaactgtgcatttggtttattatattgacaattatttgttgaaatctgatgtaatatctcaatgacatctataggtagtgcaaaacttgctcaattgccttgacagtcctgaactccctttccttcagtggcaagagtgcttgtctgttctagcaactcgccttcccaaggatcttagaagcga

SEQ ID NO: 2650 - DNA, 200 bp, Euphorbia heterophylla
tcgcttctaagatccttgggaaggcgagttgctagaacagacaagcactcttgccactgaaggaaagggagttcaggactgtcaaggcaattgagcaagttttgcactacctatagatgtcattgagatattacatcagatttcaacaaataattgtcaatataataaaccaaatgcacagttcattattttgttatgaa

SEQ ID NO: 2651 - DNA, 200 bp, Euphorbia heterophylla
gccttcccaaggatcttagaagcgaggtgaataatttttctgtaattttttcatgaccacatagtcttcttgctcacaatttgatattggcaatttgtatagttggaatcaaaatacacagagtttgaaggaatttcaagctcccagaacattgacttccctgccaaactgttaaggggtgtcctcgaggtgggttcctt

SEQ ID NO: 2652 - DNA, 200 bp, Euphorbia heterophylla
aaggaacccacctcgaggacaccccttaacagtttggcagggaagtcaatgttctgggagcttgaaattccttcaaactctgtgtattttgattccaactatacaaattgccaatatcaaattgtgagcaagaagactatgtggtcatgaaaaaattacagaaaaattattcacctcgcttctaagatccttgggaaggc

SEQ ID NO: 2653 - DNA, 200 bp, Euphorbia heterophylla
ggggtgtcctcgaggtgggttccttattgcatggctctcttggaatttctcattatctgttttttttgctgtttaatgagatgtgtatgcttttcctccaggcacacctgaaatcctgtcctgagaaagaaaaaggagccctggaaaggcttgttgaacctttgatgagtcttgtaaagtcttatgagggaggacgtgag

SEQ ID NO: 2654 - DNA, 200 bp, Euphorbia heterophylla
ctcacgtcctccctcataagactttacaagactcatcaaaggttcaacaagcctttccagggctcctttttctttctcaggacaggatttcaggtgtgcctggaggaaaagcatacacatctcattaaacagcaaaaaaaacagataatgagaaattccaagagagccatgcaataaggaacccacctcgaggacacccc

SEQ ID NO: 2655 - DNA, 200 bp, Euphorbia heterophylla
aaagtcttatgagggaggacgtgagagtcatgctcgagtgatcgtccaatcactttttgaagagtatttatctgtagaagaattatttagtgacaacatccaggttagcttcttcctatcaaacataatatggaattattttggattctgaaagtcttccctctttggcatcttttagaaaattaagcataatactgggt

SEQ ID NO: 2656 - DNA, 200 bp, Euphorbia heterophylla
acccagtattatgcttaattttctaaaagatgccaaagagggaagactttcagaatccaaaataattccatattatgtttgataggaagaagctaacctggatgttgtcactaaataattcttctacagataaatactcttcaaaaagtgattggacgatcactcgagcatgactctcacgtcctccctcataagacttt

SEQ ID NO: 2657 - DNA, 200 bp, Euphorbia heterophylla
tagaaaattaagcataatactgggtactatatccattattctttataatcatgaaatttattcttacagaagaaaagtggaatttctatatatatttaaaccaagctggcaagctttgaattcaatcctgttgtttattgttttatccaacatgccaaaaatattaggaacttcatgtgactacttgtatcattcttatt

SEQ ID NO: 2658 - DNA, 200 bp, Euphorbia heterophylla
aataagaatgatacaagtagtcacatgaagttcctaatatttttggcatgttggataaaacaataaacaacaggattgaattcaaagcttgccagcttggtttaaatatatatagaaattccacttttcttctgtaagaataaatttcatgattataaagaataatggatatagtacccagtattatgcttaattttcta

SEQ ID NO: 2659 - DNA, 200 bp, Euphorbia heterophylla
tgtgactacttgtatcattcttattctgtaattacagtaaagtaacttgtcatatcctaatgttataactcgtaacattcttctttaggctgatgtgattgaacgtctcagacttcaatataagaaagaccttttgaagatagtggacattgtcctttctcatcaggtatctgattttcggttttaatttttatctcggg

SEQ ID NO: 2660 - DNA, 200 bp, Euphorbia heterophylla
cccgagataaaaattaaaaccgaaaatcagatacctgatgagaaaggacaatgtccactatcttcaaaaggtctttcttatattgaagtctgagacgttcaatcacatcagcctaaagaagaatgttacgagttataacattaggatatgacaagttactttactgtaattacagaataagaatgatacaagtagtcaca

SEQ ID NO: 2661 - DNA, 200 bp, Euphorbia heterophylla
tttcggttttaatttttatctcgggttttctaaaatagaattctgagtttgtggaaataactaccgtatttgttggtttatagggtgttaagagtaaaaataagctgatactacggctcatggaacaacttgtttaccccaaccctgctgcatatagggataaactcattcggttctctcagcttaaccacaccagctat

SEQ ID NO: 2662 - DNA, 200 bp, Euphorbia heterophylla
atagctggtgtggttaagctgagagaaccgaatgagtttatccctatatgcagcagggttggggtaaacaagttgttccatgagccgtagtatcagcttatttttactcttaacaccctataaaccaacaaatacggtagttatttccacaaactcagaattctattttagaaaacccgagataaaaattaaaaccgaaa

SEQ ID NO: 2663 - DNA, 200 bp, Euphorbia heterophylla
ctctcagcttaaccacaccagctattccgaggttggcagctatacttggtccatctgtaatttcataaagttgttgctctgtttccttttgttcacaagttcatttttgagagttttccataggatggtgactgacaggaagaggattctaatgttttctcttggaggattttttctgtattttcatttcttgtcggtca

SEQ ID NO: 2664 - DNA, 200 bp, Euphorbia heterophylla
tgaccgacaagaaatgaaaatacagaaaaaatcctccaagagaaaacattagaatcctcttcctgtcagtcaccatcctatggaaaactctcaaaaatgaacttgtgaacaaaaggaaacagagcaacaactttatgaaattacagatggaccaagtatagctgccaacctcggaatagctggtgtggttaagctgagag

SEQ ID NO: 2665 - DNA, 200 bp, Euphorbia heterophylla
ctgtattttcatttcttgtcggtcattgattaattccgtttctggtatcagtatcatcaaaatgttgtctttttctgtatactgatgctgaattatgtgaacagttggcattgaaggcaagtcaactcctagaacaaaccaaactgagtgaactccgttccactattgctagaagcctttcggaattggagatgtttaca

SEQ ID NO: 2666 - DNA, 200 bp, Euphorbia heterophylla
tgtaaacatctccaattccgaaaggcttctagcaatagtggaacggagttcactcagtttggtttgttctaggagttgacttgccttcaatgccaactgttcacataattcagcatcagtatacagaaaaagacaacattttgatgatactgataccagaaacggaattaatcaatgaccgacaagaaatgaaaatacag

SEQ ID NO: 2667 - DNA, 200 bp, Euphorbia heterophylla
cctttcggaattggagatgtttacagaggatggtgaaaatatggatactcccaaaaggaaaagtgccattaatgaacgtatggaggatcttgtgagtgctcctttggctgttgaagatgctttagtgggtcttttcgagcacagtgatcacacccttcaaaggcgagtggtggaaacttatgttcgtaggctatatcagg

SEQ ID NO: 2668 - DNA, 200 bp, Euphorbia heterophylla
cctgatatagcctacgaacataagtttccaccactcgcctttgaagggtgtgatcactgtgctcgaaaagacccactaaagcatcttcaacagccaaaggagcactcacaagatcctccatacgttcattaatggcacttttccttttgggagtatccatattttcaccatcctctgtaaacatctccaattccgaaagg

SEQ ID NO: 2669 - DNA, 200 bp, Euphorbia heterophylla
acttatgttcgtaggctatatcaggtactgtgttgtagaaacttaaaacttttatctggtgatcaaacactagacgaaacttgatcttgatcaactgtttgtctaccgcaccagccctatctggtcaaaggtagtgtcaggatgcagtggcatagatttggtcttattgctacatgggaattcttgggagagcatatcgg

SEQ ID NO: 2670 - DNA, 200 bp, Euphorbia heterophylla
ccgatatgctctcccaagaattcccatgtagcaataagaccaaatctatgccactgcatcctgacactacctttgaccagatagggctggtgcggtagacaaacagttgatcaagatcaagtttcgtctagtgtttgatcaccagataaaagttttaagtttctacaacacagtacctgatatagcctacgaacataagt

SEQ ID NO: 2671 - DNA, 200 bp, Euphorbia heterophylla
gggaattcttgggagagcatatcgggagaaagaatggatctgaaggtcaaatgtcagatgaaccagaggctaaaaaacagtctaataagagatggggagcaatggttatcatcagatctctgcagtttttgccttcagttattggtgctgcattaagggaaacaaatcaaagccttaatgagtccattccaagtggatta

SEQ ID NO: 2672 - DNA, 200 bp, Euphorbia heterophylla
taatccacttggaatggactcattaaggctttgatttgtttcccttaatgcagcaccaataactgaaggcaaaaactgcagagatctgatgataaccattgctccccatctcttattagactgttttttagcctctggttcatctgacatttgaccttcagatccattctttctcccgatatgctctcccaagaattccc

SEQ ID NO: 2673 - DNA, 200 bp, Euphorbia heterophylla
taatgagtccattccaagtggattagtaaaatcagcgagctttggtaatatgatgcacatagcattggtaggcatcaataatcagatgagcttactacaggataggtaacttccttcggtactataatataagcgtttattttaatcataaaaattagtagcattttacattctattattcattgtaagatctcaagtct

SEQ ID NO: 2674 - DNA, 200 bp, Euphorbia heterophylla
agacttgagatcttacaatgaataatagaatgtaaaatgctactaatttttatgattaaaataaacgcttatattatagtaccgaaggaagttacctatcctgtagtaagctcatctgattattgatgcctaccaatgctatgtgcatcatattaccaaagctcgctgattttactaatccacttggaatggactcatta

SEQ ID NO: 2675 - DNA, 200 bp, Euphorbia heterophylla
ttattcattgtaagatctcaagtcttcttaatcatttctgcatttgaaaccttgatagatctggatagattccttatttttgtttaaaatttatgatagagttacctggtctcgaacccttaaaacatgcacatatattggcttgccaaacataagttattttgcgttgtcaatttcgattattgacagtcatcttgtta

SEQ ID NO: 2676 - DNA, 200 bp, Euphorbia heterophylla
taacaagatgactgtcaataatcgaaattgacaacgcaaaataacttatgtttggcaagccaatatatgtgcatgttttaagggttcgagaccaggtaactctatcataaattttaaacaaaaataaggaatctatccagatctatcaaggtttcaaatgcagaaatgattaagaagacttgagatcttacaatgaataa

SEQ ID NO: 2677 - DNA, 200 bp, Euphorbia heterophylla
tcgattattgacagtcatcttgttaatgctcctaactggcaccatctatgacattttgcagtggtgatgaggatcaggcacaagagagaattaacaagttagccaagattctcaaagaacaggaactaggttccagtttgagcttgtcaggcgttggagttattagctgtatcatacagagggatgaagggagagcccct

SEQ ID NO: 2678 - DNA, 200 bp, Euphorbia heterophylla
aggggctctcccttcatccctctgtatgatacagctaataactccaacgcctgacaagctcaaactggaacctagttcctgttctttgagaatcttggctaacttgttaattctctcttgtgcctgatcctcatcaccactgcaaaatgtcatagatggtgccagttaggagcattaacaagatgactgtcaataatcga

SEQ ID NO: 2679 - DNA, 200 bp, Euphorbia heterophylla
acagagggatgaagggagagcccctatgaggcactcctttcactggtcagaggaaaagctttattatgaggaagaacctctattgcgacatttggaacctccactatccatctaccttgaactggtttgtcacctatcgcagtgtttcaatacatttttttggcagaaacctttattgagcccctgaacttaccagtttt

SEQ ID NO: 2680 - DNA, 200 bp, Euphorbia heterophylla
aaaactggtaagttcaggggctcaataaaggtttctgccaaaaaaatgtattgaaacactgcgataggtgacaaaccagttcaaggtagatggatagtggaggttccaaatgtcgcaatagaggttcttcctcataataaagcttttcctctgaccagtgaaaggagtgcctcataggggctctcccttcatccctctgt

SEQ ID NO: 2681 - DNA, 200 bp, Euphorbia heterophylla
ttgagcccctgaacttaccagttttattctcaagttattatttgactacattaaatacttgaattactattgaatccacattacgaccttgaaaacgttttattgataaaattataactgttgctattttgttttacatatatcaaggactgcactatagtaaaaaaatgaggactcgatatgattggaaagttcagggg

SEQ ID NO: 2682 - DNA, 200 bp, Euphorbia heterophylla
cccctgaactttccaatcatatcgagtcctcatttttttactatagtgcagtccttgatatatgtaaaacaaaatagcaacagttataattttatcaataaaacgttttcaaggtcgtaatgtggattcaatagtaattcaagtatttaatgtagtcaaataataacttgagaataaaactggtaagttcaggggctcaa

SEQ ID NO: 2683 - DNA, 200 bp, Euphorbia heterophylla
ccaattaccgttgcaccattggtgactgtaaaaaaactagagcaggcagctcgaaggttagcgaaatctgtgaattatgtgggcgctgctactgttgagtatttgtacagtatggaaactggcgagtactattttctagagctcaaccctcggttacaggtggagcatcctgtcacagagtggattgctgaaataaattt

SEQ ID NO: 2684 - DNA, 200 bp, Euphorbia heterophylla
aaatttatttcagcaatccactctgtgacaggatgctccacctgtaaccgagggttgagctctagaaaatagtactcgccagtttccatactgtacaaatactcaacagtagcagcgcccacataattcacagatttcgctaaccttcgagctgcctgctctagtttttttacagtcaccaatggtgcaacggtaattgg

SEQ ID NO: 2685 - DNA, 200 bp, Euphorbia heterophylla
cagagtggattgctgaaataaatttgcctgctgcccaagtagctgttgggatgggaattcctctgtggcaaattcctgagattaggcgattttatggaatggaacatggtggaggatatgatgcttggaggaaaacttcagtggctgctacgccttttgattttgacaaggtagactctacaaagccaaaaggtcattgt

SEQ ID NO: 2686 - DNA, 200 bp, Euphorbia heterophylla
acaatgaccttttggctttgtagagtctaccttgtcaaaatcaaaaggcgtagcagccactgaagttttcctccaagcatcatatcctccaccatgttccattccataaaatcgcctaatctcaggaatttgccacagaggaattcccatcccaacagctacttgggcagcaggcaaatttatttcagcaatccactctg

SEQ ID NO: 2687 - DNA, 200 bp, Euphorbia heterophylla
ctctacaaagccaaaaggtcattgtgtagctgtacgtgtgacaagtgaggatccagatgacggtttcaagcctactagtggaaaagtactggagctgagttttaaaagcaagccaaatgtgtgggcttatttctctgtgaagtctggtggaggcattcatgaattctcagattcacaatttggacatgtttttgcatttg

SEQ ID NO: 2688 - DNA, 200 bp, Euphorbia heterophylla
caaatgcaaaaacatgtccaaattgtgaatctgagaattcatgaatgcctccaccagacttcacagagaaataagcccacacatttggcttgcttttaaaactcagctccagtacttttccactagtaggcttgaaaccgtcatctggatcctcacttgtcacacgtacagctacacaatgaccttttggctttgtagag

SEQ ID NO: 2689 - DNA, 200 bp, Euphorbia heterophylla
caatttggacatgtttttgcatttggggagtccagagctttggcaatagctaatatggttcttgggctgaaggaaatacagataagaggagaaatccgcaccaatgttgactactctgttgaccttttacatgcttcagattatagggaaaataaaattcacacaggttggttggacagtagaatagctatgagggttag

SEQ ID NO: 2690 - DNA, 200 bp, Euphorbia heterophylla
ctaaccctcatagctattctactgtccaaccaacctgtgtgaattttattttccctataatctgaagcatgtaaaaggtcaacagagtagtcaacattggtgcggatttctcctcttatctgtatttccttcagcccaagaaccatattagctattgccaaagctctggactccccaaatgcaaaaacatgtccaaattg

SEQ ID NO: 2691 - DNA, 200 bp, Euphorbia heterophylla
acagtagaatagctatgagggttagagcagaaagacctccttggtacctctctgttgttggaggggcactatataaagcatctgctagcagcgcagctatggtttctgattatgttggttaccttgaaaagggccaaatccctcccaagcacatatcacttgtgaactctcaagtttcattgaacatcgaaggaagcaaa

SEQ ID NO: 2692 - DNA, 200 bp, Euphorbia heterophylla
tttgcttccttcgatgttcaatgaaacttgagagttcacaagtgatatgtgcttgggagggatttggcccttttcaaggtaaccaacataatcagaaaccatagctgcgctgctagcagatgctttatatagtgcccctccaacaacagagaggtaccaaggaggtctttctgctctaaccctcatagctattctactgt

SEQ ID NO: 2693 - DNA, 200 bp, Euphorbia heterophylla
ccggaaggaaaatcttgatagtagcgaacgacgtgaccttcaaagccgggtctttcggcccgagagaggatgcattcttttccgccataaccgatcttgcatgcaccaaaaagctccctttagtctacctggcagcaaactctggtgctcgtataggtgttgccgaggaagtcaagtcttgctttaaagtcggttggtca

SEQ ID NO: 2694 - DNA, 200 bp, Euphorbia heterophylla
tgaccaaccgactttaaagcaagacttgacttcctcggcaacacctatacgagcaccagagtttgctgccaggtagactaaagggagctttttggtgcatgcaagatcggttatggcggaaaagaatgcatcctctctcgggccgaaagacccggctttgaaggtcacgtcgttcgctactatcaagattttccttccgg

SEQ ID NO: 2695 - DNA, 200 bp, Euphorbia heterophylla
gtcttgctttaaagtcggttggtcagatgagtcatctcccgagcgtggtttccagtacgtatatttgactcccgaggattatgtaaccattggatcatcggtgatagcacacgagctgaatcagaatggagaaacacggtgggtcatagatgccattgttgggaaagaggatggcttaggtgtcgaaaatttatcgggaa

SEQ ID NO: 2696 - DNA, 200 bp, Euphorbia heterophylla
ttcccgataaattttcgacacctaagccatcctctttcccaacaatggcatctatgacccaccgtgtttctccattctgattcagctcgtgtgctatcaccgatgatccaatggttacataatcctcgggagtcaaatatacgtactggaaaccacgctcgggagatgactcatctgaccaaccgactttaaagcaagac

SEQ ID NO: 2697 - DNA, 200 bp, Euphorbia heterophylla
ttaggtgtcgaaaatttatcgggaagtggagccattgctagtgcatactcaagggcatataaggaaaccttcacattgacatacgtaactggaagaacagtgggaatcggtgcttacctggcacgcctcgggatgagatgcatacaacggctcgatcaaccgatcatcttgaccgggttctccgcgttaaacaaactcct

SEQ ID NO: 2698 - DNA, 200 bp, Euphorbia heterophylla
aggagtttgtttaacgcggagaacccggtcaagatgatcggttgatcgagccgttgtatgcatctcatcccgaggcgtgccaggtaagcaccgattcccactgttcttccagttacgtatgtcaatgtgaaggtttccttatatgcccttgagtatgcactagcaatggctccacttcccgataaattttcgacacctaa

SEQ ID NO: 2699 - DNA, 200 bp, Euphorbia heterophylla
ggttctccgcgttaaacaaactcctcggccgtgaagtgtatagctctcacatgcaactcggcggtccgaaaattatggccaccaatggggtagtccatcgcaccgtctccgatgacctcgaaggtatttcggaaatcctgaaatggctaagctgtattccccctcaaagcggcggggcaattccggtatttccttctccg

SEQ ID NO: 2700 - DNA, 200 bp, Euphorbia heterophylla
cggagaaggaaataccggaattgccccgccgctttgagggggaatacagcttagccatttcaggatttccgaaataccttcgaggtcatcggagacggtgcgatggactaccccattggtggccataattttcggaccgccgagttgcatgtgagagctatacacttcacggccgaggagtttgtttaacgcggagaacc

SEQ ID NO: 2701 - DNA, 200 bp, Euphorbia heterophylla
ggcaattccggtatttccttctccggatcctccggagcgacccgtggagtacttcccagaaacatcgtgcgacccgcgggcggccatctcgggtacaatggacggcagcgggaagaagtggctcgggggtattttcgacaaagacagcttcgtggagacactggaagggtgggcgaggaccgtggtgaccgggcgggcaa

SEQ ID NO: 2702 - DNA, 200 bp, Euphorbia heterophylla
ttgcccgcccggtcaccacggtcctcgcccacccttccagtgtctccacgaagctgtctttgtcgaaaatacccccgagccacttcttcccgctgccgtccattgtacccgagatggccgcccgcgggtcgcacgatgtttctgggaagtactccacgggtcgctccggaggatccggagaaggaaataccggaattgcc

SEQ ID NO: 2703 - DNA, 200 bp, Euphorbia heterophylla
aggaccgtggtgaccgggcgggcaaagctcggggggattccggttgggataatagccgtcgagactcaaaccgtgatgcaagtgatccccgccgacccgggccagctggactcgcacgagcgggtcgtgccccaggcgggtcaagtatggttcccagattcggcgaataaaaccgcccaagcgattatggatttcaaccg

SEQ ID NO: 2704 - DNA, 200 bp, Euphorbia heterophylla
cggttgaaatccataatcgcttgggcggttttattcgccgaatctgggaaccatacttgacccgcctggggcacgacccgctcgtgcgagtccagctggcccgggtcggcggggatcacttgcatcacggtttgagtctcgacggctattatcccaaccggaatccccccgagctttgcccgcccggtcaccacggtcct

SEQ ID NO: 2705 - DNA, 200 bp, Euphorbia heterophylla
cccaagcgattatggatttcaaccgagaagagctcccgctctttatcctcgccaactggcgaggcttctcgggcggccaacgagacctcttcgaaggtatccttcaggcggggtccaccatagtggaaaacttaaggacatataaccaaccggttttcgtatacatccctatgatgggcgagcttcgtggtggggcctgg

SEQ ID NO: 2706 - DNA, 200 bp, Euphorbia heterophylla
ccaggccccaccacgaagctcgcccatcatagggatgtatacgaaaaccggttggttatatgtccttaagttttccactatggtggaccccgcctgaaggataccttcgaagaggtctcgttggccgcccgagaagcctcgccagttggcgaggataaagagcgggagctcttctcggttgaaatccataatcgcttggg

SEQ ID NO: 2707 - DNA, 200 bp, Euphorbia heterophylla
gggcgagcttcgtggtggggcctgggttgttgtggacagtcagataaattctgaccacatcgagatgtacgctgatcggacggctaaaggcaacgtccttgaaccggaaggaataatcgagatcaagtttagaacaaaggagttgctcgattgcatgaatcgactcgacccaaagctgatatcttttaaaaccaaactaa

SEQ ID NO: 2708 - DNA, 200 bp, Euphorbia heterophylla
ttagtttggttttaaaagatatcagctttgggtcgagtcgattcatgcaatcgagcaactcctttgttctaaacttgatctcgattattccttccggttcaaggacgttgcctttagccgtccgatcagcgtacatctcgatgtggtcagaatttatctgactgtccacaacaacccaggccccaccacgaagctcgccc

SEQ ID NO: 2709 - DNA, 200 bp, Euphorbia heterophylla
ctgatatcttttaaaaccaaactaaccgaagcgaagaatagtgggacctacgggatggtcgattccgtacaacagcagataaaatcccgggaaaagcaacttctgccgctatacacacaaatcgccacacgattcgccgagcttcacgactcggctttacgaatggcggcaaagggggtgattcgagaagttgtcgactg

SEQ ID NO: 2710 - DNA, 200 bp, Euphorbia heterophylla
cagtcgacaacttctcgaatcaccccctttgccgccattcgtaaagccgagtcgtgaagctcggcgaatcgtgtggcgatttgtgtgtatagcggcagaagttgcttttcccgggattttatctgctgttgtacggaatcgaccatcccgtaggtcccactattcttcgcttcggttagtttggttttaaaagatatcag

SEQ ID NO: 2711 - DNA, 200 bp, Euphorbia heterophylla
gggtgattcgagaagttgtcgactgggggatttcacgatcttacttctacaaaaggttaagaaggagaatcgccgaggcttcgttggtgaacaccgtgaaagatgcagcgggtgataagctccagcataagtcggctatggagttggtcaaaaactggtttctggactcgaaaggcgattgggaaaacgatgaagctttc

SEQ ID NO: 2712 - DNA, 200 bp, Euphorbia heterophylla
gaaagcttcatcgttttcccaatcgcctttcgagtccagaaaccagtttttgaccaactccatagccgacttatgctggagcttatcacccgctgcatctttcacggtgttcaccaacgaagcctcggcgattctccttcttaaccttttgtagaagtaagatcgtgaaatcccccagtcgacaacttctcgaatcaccc

SEQ ID NO: 2713 - DNA, 200 bp, Euphorbia heterophylla
cgattgggaaaacgatgaagctttctatgcttggaaggataatcccgcgaattacgaggaaaagctacaggagttacgggtccagaaggtgttgcttcagttaactaacattggcgagtctttgtcggatttgaaagctttacctcaaggtcttgctgcccttctaaataaggtggagccatcgagccgaggggcgttga

SEQ ID NO: 2714 - DNA, 200 bp, Euphorbia heterophylla
tcaacgcccctcggctcgatggctccaccttatttagaagggcagcaagaccttgaggtaaagctttcaaatccgacaaagactcgccaatgttagttaactgaagcaacaccttctggacccgtaactcctgtagcttttcctcgtaattcgcgggattatccttccaagcatagaaagcttcatcgttttcccaatcg

SEQ ID NO: 2715 - DNA, 200 bp, Euphorbia heterophylla
gagccatcgagccgaggggcgttgatcgatgagcttcggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtga

SEQ ID NO: 2716 - DNA, 200 bp, Euphorbia heterophylla
tcacttaaatataataatagttacatttacacttatcaaatatattactgggtattttcacattggcattttctattgattcaaactacccagagactgaagccaaagtaaaacatatttagtagccgagaaacacttaccgaaaatcaattaagcaccttccgaagctcatcgatcaacgcccctcggctcgatggctc

SEQ ID NO: 2717 - DNA, 200 bp, Euphorbia heterophylla
taatatgatgcacatagcattggtaggcatcaataatcagatgagcttactacaggatagtggtgatgaggatcaggcacaagagagaattaacaagttagccaagattctcaaagaacaggaactaggttccagtttgagcttgtcaggcgttggagttattagctgtatcatacagagggatgaagggagagccccta

SEQ ID NO: 2718 - DNA, 200 bp, Euphorbia heterophylla
taggggctctcccttcatccctctgtatgatacagctaataactccaacgcctgacaagctcaaactggaacctagttcctgttctttgagaatcttggctaacttgttaattctctcttgtgcctgatcctcatcaccactatcctgtagtaagctcatctgattattgatgcctaccaatgctatgtgcatcatatta

SEQ ID NO: 2719 - DNA, 200 bp, Euphorbia heterophylla
cagagggatgaagggagagcccctatgaggcactcctttcactggtcagaggaaaagctttatatgaggaagaacctctattgcgacatttggaacctccactatccatctaccttgaactggacaaacttaaaggctatgacaatagacaatatactcagtcaagggacagacaatggcacatgtacactgttgtagac

SEQ ID NO: 2720 - DNA, 200 bp, Euphorbia heterophylla
gtctacaacagtgtacatgtgccattgtctgtcccttgactgagtatattgtctattgtcatagcctttaagtttgtccagttcaaggtagatggatagtggaggttccaaatgtcgcaatagaggttcttcctcatataaagcttttcctctgaccagtgaaaggagtgcctcataggggctctcccttcatccctctg

SEQ ID NO: 2721 - DNA, 200 bp, Euphorbia heterophylla
atggcacatgtacactgttgtagacaaaccagttccaatccagaggatgtttctaagaacccttgtgagacagcccacaagtacttcatatcaaggtcttggcgccgaagcacccaatgtgcagtgggccatgtcctttacgtcaaagagcattttgaggtccttagtagctgcaatggaggaactggagcttcacgtgc

SEQ ID NO: 2722 - DNA, 200 bp, Euphorbia heterophylla
gcacgtgaagctccagttcctccattgcagctactaaggacctcaaaatgctctttgacgtaaaggacatggcccactgcacattgggtgcttcggcgccaagaccttgatatgaagtacttgtgggctgtctcacaagggttcttagaaacatcctctggattggaactggtttgtctacaacagtgtacatgtgccat

SEQ ID NO: 2723 - DNA, 200 bp, Euphorbia heterophylla
atggaggaactggagcttcacgtgcacactgtcaaatctgaccatgctcatatgtacctctgcatattgagggagcaacggatagaagatcttgttccatacacgaagaaaaccgatgtagatgccaaccaagaagaagctgcggtagcaagaatcttggaagaactagcgaggaagatacatgcgtcggttggagtcag

SEQ ID NO: 2724 - DNA, 200 bp, Euphorbia heterophylla
ctgactccaaccgacgcatgtatcttcctcgctagttcttccaagattcttgctaccgcagcttcttcttggttggcatctacatcggttttcttcgtgtatggaacaagatcttctatccgttgctccctcaatatgcagaggtacatatgagcatggtcagatttgacagtgtgcacgtgaagctccagttcctccat

SEQ ID NO: 2725 - DNA, 200 bp, Euphorbia heterophylla
agatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatatatatcgggaacttggggacgacagcaaacacgaagtggtttaccattcgatc

SEQ ID NO: 2726 - DNA, 200 bp, Euphorbia heterophylla
gatcgaatggtaaaccacttcgtgtttgctgtcgtccccaagttcccgatatatatgcacagcacaggtatgcccagtcacatttgttgtgacaactctccaagcaccatttgcctgtccagatgatgtcatccatagcttcacttcccactcgcaaacatttaacctatgcattctgactccaaccgacgcatgtatct

SEQ ID NO: 2727 - DNA, 200 bp, Euphorbia heterophylla
acacgaagtggtttaccattcgatctctccaagaggcccactgcatagcatgccagtgaatgctgtttatcagcccttgggagttctcgatcgaaaacgtttgttggcaaggaagagcaacaccacttactgctatgattttccactggcgtttgagacagccatcgaacaattatgggaatctcaatcaccagggactg

SEQ ID NO: 2728 - DNA, 200 bp, Euphorbia heterophylla
cagtccctggtgattgagattcccataattgttcgatggctgtctcaaacgccagtggaaaatcatagcagtaagtggtgttgctcttccttgccaacaaacgttttcgatcgagaactcccaagggctgataaacagcattcactggcatgctatgcagtgggcctcttggagagatcgaatggtaaaccacttcgtgt

SEQ ID NO: 2729 - DNA, 200 bp, Euphorbia heterophylla
tgggaatctcaatcaccagggactgaaagaagcaaagaaaacgtcctaaaagtctcggagcttgtttttgccgatcagaaaggtacctggggaactccacttgttcatgcagaacggccagctgggcttaatgacgtgggcatggtagcatggtgcatggaaatgttcaccccggaatgcccttccggaaggaaatcttg

SEQ ID NO: 2730 - DNA, 200 bp, Euphorbia heterophylla
caagatttccttccggaagggcattccggggtgaacatttccatgcaccatgctaccatgcccacgtcattaagcccagctggccgttctgcatgaacaagtggagttccccaggtacctttctgatcggcaaaaacaagctccgagacttttaggacgttttctttgcttctttcagtccctggtgattgagattccca

SEQ ID NO: 2731 - DNA, 200 bp, Euphorbia heterophylla
tatataaatgtgaaattggataattctatatcattcatctgaagcttattatggccttttttgatccaggacaaacttaaaggctatgacaatagacaatatactcagtcaagggacagacaatggcacatgtacactgttgtagacaaaccagttccaatccagaggatgtttctaagaacccttgtgagacagcccac

SEQ ID NO: 2732 - DNA, 200 bp, Euphorbia heterophylla
gtgggctgtctcacaagggttcttagaaacatcctctggattggaactggtttgtctacaacagtgtacatgtgccattgtctgtcccttgactgagtatattgtctattgtcatagcctttaagtttgtcctggatcaaaaaaggccataataagcttcagatgaatgatatagaattatccaatttcacatttatata

SEQ ID NO: 2733 - DNA, 200 bp, Euphorbia heterophylla
taagaacccttgtgagacagcccacaagtacttcatatcaaggtcttggcgccgaagcacccaatgtgcagtgggccatgtcctttacgtcaaagagcattttgaggtccttagtagctgcaatggaggaactggagcttcacgtgcacactgtcaaatctgaccatgctcatatgtacctctgcatattgagggagcaa

SEQ ID NO: 2734 - DNA, 200 bp, Euphorbia heterophylla
ttgctccctcaatatgcagaggtacatatgagcatggtcagatttgacagtgtgcacgtgaagctccagttcctccattgcagctactaaggacctcaaaatgctctttgacgtaaaggacatggcccactgcacattgggtgcttcggcgccaagaccttgatatgaagtacttgtgggctgtctcacaagggttctta

SEQ ID NO: 2735 - DNA, 200 bp, Euphorbia heterophylla
gtacctctgcatattgagggagcaacggatagaagatcttgttccatacacgaagtaattatatcaatctttatgatttatcgtgtacttggcaccataactttatgtgtactcactatgagactccatctccaggaaaaccgatgtagatgccaaccaagaagaagctgcggtagcaagaatcttggaagaactagcga

SEQ ID NO: 2736 - DNA, 200 bp, Euphorbia heterophylla
tcgctagttcttccaagattcttgctaccgcagcttcttcttggttggcatctacatcggttttcctggagatggagtctcatagtgagtacacataaagttatggtgccaagtacacgataaatcataaagattgatataattacttcgtgtatggaacaagatcttctatccgttgctccctcaatatgcagaggtac

SEQ ID NO: 2737 - DNA, 200 bp, Euphorbia heterophylla
gcaagaatcttggaagaactagcgaggaagatacatgcgtcggttggagtcagaatgcataggttaaatgtttgcgagtgggaagtgaagctatggatgacatcatctggacaggcaaatggtgcttggagagttgtcacaacaaatgtgactgggcatacctgtgctgtgcatgtaagtatctgcgcatcttatttcaa

SEQ ID NO: 2738 - DNA, 200 bp, Euphorbia heterophylla
ttgaaataagatgcgcagatacttacatgcacagcacaggtatgcccagtcacatttgttgtgacaactctccaagcaccatttgcctgtccagatgatgtcatccatagcttcacttcccactcgcaaacatttaacctatgcattctgactccaaccgacgcatgtatcttcctcgctagttcttccaagattcttgc

SEQ ID NO: 2739 - DNA, 200 bp, Euphorbia heterophylla
taagtatctgcgcatcttatttcaagaaaatgtctttcccttccatgcattccttattagtcgacttagtaatggggaatgtcgagaagtgttggatggttaccaatgtgagtaccatcactgtttagattaaaattgaccattgctttagcaatacaataatgaatctaattgtggcatgggaggcttttctatgtgtg

SEQ ID NO: 2740 - DNA, 200 bp, Euphorbia heterophylla
cacacatagaaaagcctcccatgccacaattagattcattattgtattgctaaagcaatggtcaattttaatctaaacagtgatggtactcacattggtaaccatccaacacttctcgacattccccattactaagtcgactaataaggaatgcatggaagggaaagacattttcttgaaataagatgcgcagatactta

SEQ ID NO: 2741 - DNA, 200 bp, Euphorbia heterophylla
ggcatgggaggcttttctatgtgtgatccatggaaaaacttgtatatagttccttagtaggtttgagttgttttcatttttcttttatcacattgtaattgtattggtgattgatacgaaaattagatatatcgggaacttggggacgacagcaaacacgaagtggtttaccattcgatctctccaagaggcccactgca

SEQ ID NO: 2742 - DNA, 200 bp, Euphorbia heterophylla
tgcagtgggcctcttggagagatcgaatggtaaaccacttcgtgtttgctgtcgtccccaagttcccgatatatctaattttcgtatcaatcaccaatacaattacaatgtgataaaagaaaaatgaaaacaactcaaacctactaaggaactatatacaagtttttccatggatcacacatagaaaagcctcccatgcc

SEQ ID NO: 2743 - DNA, 200 bp, Euphorbia heterophylla
cgatctctccaagaggcccactgcatagcatgccagtgaatgctgtttatcagcccttgggagttctcgatcgaaaacgtttgttggcaaggaagagcaacaccacttactgctatgattttccactggttagtatttatataatcattaatcaaacatcagtttttttattggggataactaaaatcaaataatttttc

SEQ ID NO: 2744 - DNA, 200 bp, Euphorbia heterophylla
gaaaaattatttgattttagttatccccaataaaaaaactgatgtttgattaatgattatataaatactaaccagtggaaaatcatagcagtaagtggtgttgctcttccttgccaacaaacgttttcgatcgagaactcccaagggctgataaacagcattcactggcatgctatgcagtgggcctcttggagagatcg

SEQ ID NO: 2745 - DNA, 200 bp, Euphorbia heterophylla
gataactaaaatcaaataatttttcctggcctcatccttttcaggcgttcgagacagccatcgaacaattatgggaatctcaatcaccagggactgaaagaaacaaagaaaaagtcctaaaagtctcggagcttgtttttgccgatcagaaaggtacctggggaactccacttgttcatgcagaacggccagctgggctt

SEQ ID NO: 2746 - DNA, 200 bp, Euphorbia heterophylla
aagcccagctggccgttctgcatgaacaagtggagttccccaggtacctttctgatcggcaaaaacaagctccgagacttttaggactttttctttgtttctttcagtccctggtgattgagattcccataattgttcgatggctgtctcgaacgcctgaaaaggatgaggccaggaaaaattatttgattttagttatc

SEQ ID NO: 2747 - DNA, 200 bp, Euphorbia heterophylla
tcatgcagaacggccagctgggcttaacgacgtgggcatggtagcatggtgcatggaaatgttcaccccagaatgcccttccggaaggaaaatcttgatagtagcgaacgacgtgaccttcaaagccgggtctttcggtccaagagaggatgcattcttttccgccataaccgatctggcatgcaccaaaaagctccctt

SEQ ID NO: 2748 - DNA, 200 bp, Euphorbia heterophylla
aagggagctttttggtgcatgccagatcggttatggcggaaaagaatgcatcctctcttggaccgaaagacccggctttgaaggtcacgtcgttcgctactatcaagattttccttccggaagggcattctggggtgaacatttccatgcaccatgctaccatgcccacgtcgttaagcccagctggccgttctgcatga

SEQ ID NO: 2749 - DNA, 200 bp, Euphorbia heterophylla
ctggcatgcaccaaaaagctccctttagtctacctggcagcaaactctggtgctcgtataggtgttgccgaggaagtcaagtcttgctttaaagtcggttggtcagatgagtcatctcccgagcgtggtttccagtacgtatatttgactcccgaggattatgcaaccattggatcatcggtgatagcacacgagctgaa

SEQ ID NO: 2750 - DNA, 200 bp, Euphorbia heterophylla
ttcagctcgtgtgctatcaccgatgatccaatggttgcataatcctcgggagtcaaatatacgtactggaaaccacgctcgggagatgactcatctgaccaaccgactttaaagcaagacttgacttcctcggcaacacctatacgagcaccagagtttgctgccaggtagactaaagggagctttttggtgcatgccag

SEQ ID NO: 2751 - DNA, 200 bp, Euphorbia heterophylla
catcggtgatagcacacgagctgaatcagaatggagaaacacggtgggtcatagatgccattgttgggaaagaggatggcttaggtgtcgaaaatttatcgggaagtggagccattgctagtgcatactcaagggcatataaggaaaccttcacattgacatacgtaactggaagaacagtgggaatcggtgcttacctg

SEQ ID NO: 2752 - DNA, 200 bp, Euphorbia heterophylla
caggtaagcaccgattcccactgttcttccagttacgtatgtcaatgtgaaggtttccttatatgcccttgagtatgcactagcaatggctccacttcccgataaattttcgacacctaagccatcctctttcccaacaatggcatctatgacccaccgtgtttctccattctgattcagctcgtgtgctatcaccgatg

SEQ ID NO: 2753 - DNA, 200 bp, Euphorbia heterophylla
aacagtgggaatcggtgcttacctggcacgcctcgggatgagatgcatacaacggctcgatcaaccgatcatcttgaccgggttctccgcgttaaacaaactcctcggccgtgaagtgtatagctctcacatgcaactcggcggtccgaaaattatggccaccaatggggtagtccatcgcaccgtctccgatgacctcg

SEQ ID NO: 2754 - DNA, 200 bp, Euphorbia heterophylla
cgaggtcatcggagacggtgcgatggactaccccattggtggccataattttcggaccgccgagttgcatgtgagagctatacacttcacggccgaggagtttgtttaacgcggagaacccggtcaagatgatcggttgatcgagccgttgtatgcatctcatcccgaggcgtgccaggtaagcaccgattcccactgtt

SEQ ID NO: 2755 - DNA, 200 bp, Euphorbia heterophylla
catcgcaccgtctccgatgacctcgaaggtatttcggaaatcctgaaatggctaagctgtattccccctcaaagcggcggggcaattccggtatttccttctccggatcctccggagcgacccgtggagtacttcccagaaacatcgtgcgacccgcgggcggccatctcgggtacaatggacggcagcgggaagaagtg

SEQ ID NO: 2756 - DNA, 200 bp, Euphorbia heterophylla
cacttcttcccgctgccgtccattgtacccgagatggccgcccgcgggtcgcacgatgtttctgggaagtactccacgggtcgctccggaggatccggagaaggaaataccggaattgccccgccgctttgagggggaatacagcttagccatttcaggatttccgaaataccttcgaggtcatcggagacggtgcgatg

SEQ ID NO: 2757 - DNA, 200 bp, Euphorbia heterophylla
caatggacggcagcgggaagaagtggctcgggggtattttcgacaaagacagcttcgtggagacactggaagggtgggcgaggaccgtggtgaccgggcgggcaaagctcggggggattccggttgggataatagccgtcgagactcaaaccgtggtgcaagtgatccccgccgacccgggccagctggactcgcacgag

SEQ ID NO: 2758 - DNA, 200 bp, Euphorbia heterophylla
ctcgtgcgagtccagctggcccgggtcggcggggatcacttgcaccacggtttgagtctcgacggctattatcccaaccggaatccccccgagctttgcccgcccggtcaccacggtcctcgcccacccttccagtgtctccacgaagctgtctttgtcgaaaatacccccgagccacttcttcccgctgccgtccattg

SEQ ID NO: 2759 - DNA, 200 bp, Euphorbia heterophylla
cccgggccagctggactcgcacgagcgggtcgtgccccaggcgggtcaagtatggttcccagattcggcgaataaaaccgcccaagcgattatggatttcaaccgagaagagctcccgctctttatcctcgccaactggcgaggcttctcgggcggccaacgagacctcttcgaaggtatcctacaggcggggtccacca

SEQ ID NO: 2760 - DNA, 200 bp, Euphorbia heterophylla
tggtggaccccgcctgtaggataccttcgaagaggtctcgttggccgcccgagaagcctcgccagttggcgaggataaagagcgggagctcttctcggttgaaatccataatcgcttgggcggttttattcgccgaatctgggaaccatacttgacccgcctggggcacgacccgctcgtgcgagtccagctggcccggg

SEQ ID NO: 2761 - DNA, 200 bp, Euphorbia heterophylla
ggtatcctacaggcggggtccaccatagtggaaaacttaaggacatataaccaaccggttttcgtatacatccctatgatgggcgagcttcgtggtggggcctgggttgttgtggacagtcagataaattctgaccacatcgagatgtacgctgatcggacggctaaaggcaacgtccttgaaccggaaggaataatcga

SEQ ID NO: 2762 - DNA, 200 bp, Euphorbia heterophylla
tcgattattccttccggttcaaggacgttgcctttagccgtccgatcagcgtacatctcgatgtggtcagaatttatctgactgtccacaacaacccaggccccaccacgaagctcgcccatcatagggatgtatacgaaaaccggttggttatatgtccttaagttttccactatggtggaccccgcctgtaggatacc

SEQ ID NO: 2763 - DNA, 200 bp, Euphorbia heterophylla
tccttgaaccggaaggaataatcgagatcaagtttagaacaaaggagttgctcgattgcatgaatcgactcgacccaaagctgatatctttaaaaaccaaactaaccgaagcgaagaatagtgggacctacgggatggtcgattccgtacaacagctgataaaatcccgggaaaagcaacttctgccgctttacacgcaa

SEQ ID NO: 2764 - DNA, 200 bp, Euphorbia heterophylla
ttgcgtgtaaagcggcagaagttgcttttcccgggattttatcagctgttgtacggaatcgaccatcccgtaggtcccactattcttcgcttcggttagtttggtttttaaagatatcagctttgggtcgagtcgattcatgcaatcgagcaactcctttgttctaaacttgatctcgattattccttccggttcaagga

SEQ ID NO: 2765 - DNA, 200 bp, Euphorbia heterophylla
gcaacttctgccgctttacacgcaaatcgccacacgattcgccgagcttcacgactcggctttacgaatggcggcaaagggggtgattcgagaagttgtcgactgggggatttcacgatcttacttctacaaaaggttaagaaggagaatcgccgaggcttcgttggtgaacaccgtgaaagatgcagcgggtgataagc

SEQ ID NO: 2766 - DNA, 200 bp, Euphorbia heterophylla
gcttatcacccgctgcatctttcacggtgttcaccaacgaagcctcggcgattctccttcttaaccttttgtagaagtaagatcgtgaaatcccccagtcgacaacttctcgaatcaccccctttgccgccattcgtaaagccgagtcgtgaagctcggcgaatcgtgtggcgatttgcgtgtaaagcggcagaagttgc

SEQ ID NO: 2767 - DNA, 200 bp, Euphorbia heterophylla
gtgaaagatgcagcgggtgataagctccagcataagtcggctatggagttggtcaaaaactggtttctggactcgaaaggcgattgggaaaacgatgaagctttctatgcttggaaggataatcccgcgaattacgaggaaaagctacaggagttacgggtccagaaggtgttgcttcagttaactaacattggcgagtc

SEQ ID NO: 2768 - DNA, 200 bp, Euphorbia heterophylla
gactcgccaatgttagttaactgaagcaacaccttctggacccgtaactcctgtagcttttcctcgtaattcgcgggattatccttccaagcatagaaagcttcatcgttttcccaatcgcctttcgagtccagaaaccagtttttgaccaactccatagccgacttatgctggagcttatcacccgctgcatctttcac

SEQ ID NO: 2769 - DNA, 200 bp, Euphorbia heterophylla
ttcagttaactaacattggcgagtctttgtcggatttgaaagctttacctcaaggtcttgctgcccttctaaataaggtaattttttgggttttttcttccaggaatattgtttatttagacgatcggagtcggatgttatgtaacactttatgtttgatgtaggtggagccatcgagccgaggggcgttgatcgatgag

SEQ ID NO: 2770 - DNA, 200 bp, Euphorbia heterophylla
ctcatcgatcaacgcccctcggctcgatggctccacctacatcaaacataaagtgttacataacatccgactccgatcgtctaaataaacaatattcctggaagaaaaaacccaaaaaattaccttatttagaagggcagcaagaccttgaggtaaagctttcaaatccgacaaagactcgccaatgttagttaactgaa

SEQ ID NO: 2771 - DNA, 200 bp, Euphorbia heterophylla
gagccgaggggcgttgatcgatgagcttcggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtgaataggggg

SEQ ID NO: 2772 - DNA, 200 bp, Euphorbia heterophylla
ccccctattcacttaaatataataatagttacatttacacttatcaaatatattactgggtattttcacattggcattttctattgattcaaactacccagagactgaagccaaagtaaaacatatttagtagccgagaaacacttaccgaaaatcaattaagcaccttccgaagctcatcgatcaacgcccctcggctc

SEQ ID NO: 2773 - DNA, 200 bp, Euphorbia heterophylla
ttattatatttaagtgaatagggggaattagttcatatgattattgttgttataaacaaatcagagatagagagagctatatttattattatatttgcgaattaaagttattaggagtagtataatttggcggttgttgcattttacgtgtaatgatctgaatgttgtttgttcgtgattattgaataaaagggcatcaa

SEQ ID NO: 2774 - DNA, 200 bp, Euphorbia heterophylla
ttgatgcccttttattcaataatcacgaacaaacaacattcagatcattacacgtaaaatgcaacaaccgccaaattatactactcctaataactttaattcgcaaatataataataaatatagctctctctatctctgatttgtttataacaacaataatcatatgaactaattccccctattcacttaaatataataa

SEQ ID NO: 2775 - DNA, 200 bp, Euphorbia heterophylla
tgattattgaataaaagggcatcaaatgccataatttatctttctttgttaacaagattttaattagttttttttaattattagtatgttttgtataatttatatttgactaattaatgagttctttctgaatttataccaaaatttcaatataatactgaatttaaaacttgagtctagattaccaacaaggtgtagct

SEQ ID NO: 2776 - DNA, 200 bp, Euphorbia heterophylla
agctacaccttgttggtaatctagactcaagttttaaattcagtattatattgaaattttggtataaattcagaaagaactcattaattagtcaaatataaattatacaaaacatactaataattaaaaaaaactaattaaaatcttgttaacaaagaaagataaattatggcatttgatgcccttttattcaataatca

SEQ ID NO: 2777 - DNA, 200 bp, Euphorbia heterophylla
tctagattaccaacaaggtgtagctcagttggcaacgcaggctgggtaagttggaggagaacaatgtttgaatcctactaaatacacttgttgggaggggtgatgagccttaactgtgattaagtcccgaacaagattatctcaatggtgatacttgtaattattaccaaaaaaaacttgagtctacgatgcaaatatgt

SEQ ID NO: 2778 - DNA, 200 bp, Euphorbia heterophylla
acatatttgcatcgtagactcaagttttttttggtaataattacaagtatcaccattgagataatcttgttcgggacttaatcacagttaaggctcatcacccctcccaacaagtgtatttagtaggattcaaacattgttctcctccaacttacccagcctgcgttgccaactgagctacaccttgttggtaatctaga

SEQ ID NO: 2779 - DNA, 200 bp, Euphorbia heterophylla
acttgagtctacgatgcaaatatgtattatctaggcatggtctaattagatttaaatatgggctgattggatttaaatttctctttttttagtacgatcttattaattcaaattagagtccattacatttctaatggatgagaaaccacgtcctcctctatgtcaaagaaatagatgtcttggctaataaatggacaact

SEQ ID NO: 2780 - DNA, 200 bp, Euphorbia heterophylla
agttgtccatttattagccaagacatctatttctttgacatagaggaggacgtggtttctcatccattagaaatgtaatggactctaatttgaattaataagatcgtactaaaaaaagagaaatttaaatccaatcagcccatatttaaatctaattagaccatgcctagataatacatatttgcatcgtagactcaagt

SEQ ID NO: 2781 - DNA, 200 bp, Euphorbia heterophylla
tgtcttggctaataaatggacaacttgattcgtagacctattaacaaaaacaacttttaaacctaaaaaagaggtcatgagtattttgcaatcgaaaatagtgaaacctattgacgaatgaagaggagagttgatcagagcatatagctcgagaatgacactatccaagccttggctctttagtcaactgagcgcctctc

SEQ ID NO: 2782 - DNA, 200 bp, Euphorbia heterophylla
gagaggcgctcagttgactaaagagccaaggcttggatagtgtcattctcgagctatatgctctgatcaactctcctcttcattcgtcaataggtttcactattttcgattgcaaaatactcatgacctcttttttaggtttaaaagttgtttttgttaataggtctacgaatcaagttgtccatttattagccaagaca

SEQ ID NO: 2783 - DNA, 200 bp, Euphorbia heterophylla
ctctttagtcaactgagcgcctctctgcaactcatagcctctactagaagaacatcttgcatgagagaggattgggctgctacaaatctacccatataatctcgaattacacagccattcatctaccattctcaaacacactagcacgttacatttaaatccaatgttgttttagctttggatgttttgtgtgtcattaa

SEQ ID NO: 2784 - DNA, 200 bp, Euphorbia heterophylla
ttaatgacacacaaaacatccaaagctaaaacaacattggatttaaatgtaacgtgctagtgtgtttgagaatggtagatgaatggctgtgtaattcgagattatatgggtagatttgtagcagcccaatcctctctcatgcaagatgttcttctagtagaggctatgagttgcagagaggcgctcagttgactaaagag

SEQ ID NO: 2785 - DNA, 200 bp, Euphorbia heterophylla
ctttggatgttttgtgtgtcattaatgtttgttgtctgccattcactgaggaaccccaaactgtgcctaataacttgggaatcaattcgaaaacgttgattccaagcccagctattccttctgggaccatatagtgcacaaaatcaaatccaccaatctgtgatggaagctatcgaatatggccacccattgctgcaaat

SEQ ID NO: 2786 - DNA, 200 bp, Euphorbia heterophylla
atttgcagcaatgggtggccatattcgatagcttccatcacagattggtggatttgattttgtgcactatatggtcccagaaggaatagctgggcttggaatcaacgttttcgaattgattcccaagttattaggcacagtttggggttcctcagtgaatggcagacaacaaacattaatgacacacaaaacatccaaag

SEQ ID NO: 2787 - DNA, 200 bp, Euphorbia heterophylla
aatatggccacccattgctgcaaatgcccgaccataacgcgagagcaaatggtcaggtaacgagggcgtgataagtcaatgtgtcgtgtcagccccatcactgcatatagaaccaacatggtcgatcataatatgcttatcttgaagcctaaccaacgttggtaatgggagtcccaccatcgctactttccaaaaaaaga

SEQ ID NO: 2788 - DNA, 200 bp, Euphorbia heterophylla
tctttttttggaaagtagcgatggtgggactcccattaccaacgttggttaggcttcaagataagcatattatgatcgaccatgttggttctatatgcagtgatggggctgacacgacacattgacttatcacgccctcgttacctgaccatttgctctcgcgttatggtcgggcatttgcagcaatgggtggccatatt

SEQ ID NO: 2789 - DNA, 200 bp, Euphorbia heterophylla
tcgctcataatcgcttgatcgcagtcctattcgagttcaatttttttgagattccgcttatattttcagaatgttggagacacagaggaggcagccgttagcagtaggggttactcgtgggaatgatttcaccaatggtgtgcttacgatgagaagccctgctacaatatcagaagtagatcaattttgccgtgctcttg

SEQ ID NO: 2790 - DNA, 200 bp, Euphorbia heterophylla
caagagcacggcaaaattgatctacttctgatattgtagcagggcttctcatcgtaagcacaccattggtgaaatcattcccacgagtaacccctactgctaacggctgcctcctctgtgtctccaacattctgaaaatataagcggaatctcaaaaaaattgaactcgaataggactgcgatcaagcgattatgagcga

SEQ ID NO: 2791 - DNA, 200 bp, Euphorbia heterophylla
gtagatcaattttgccgtgctcttggaggaaagagaccgatccacagtatattaattgcaaacaatggaatggcagctgtcaagtttatacgaagtgttaggacatgggcttatgaaacttttggcactgaaaaggctatcttgttggtggccatggcaactccagaagacatgaggatcaatgcagagcatattagaat

SEQ ID NO: 2792 - DNA, 200 bp, Euphorbia heterophylla
attctaatatgctctgcattgatcctcatgtcttctggagttgccatggccaccaacaagatagccttttcagtgccaaaagtttcataagcccatgtcctaacacttcgtataaacttgacagctgccattccattgtttgcaattaatatactgtggatcggtctctttcctccaagagcacggcaaaattgatctac

SEQ ID NO: 2793 - DNA, 200 bp, Euphorbia heterophylla
ggatcaatgcagagcatattagaatagctgatcagtttgtggaagttcctggggggacaaacaataacaattatgccaatgtgcaactcattgttgagatggcagaggtcacccatgttgatgcagtttggcctggttggggacatgcatctgaaaacccagagcttccagatgcactaactgcaaagggaatcgtattt

SEQ ID NO: 2794 - DNA, 200 bp, Euphorbia heterophylla
aaatacgattccctttgcagttagtgcatctggaagctctgggttttcagatgcatgtccccaaccaggccaaactgcatcaacatgggtgacctctgccatctcaacaatgagttgcacattggcataattgttattgtttgtccccccaggaacttccacaaactgatcagctattctaatatgctctgcattgatcc

SEQ ID NO: 2795 - DNA, 200 bp, Euphorbia heterophylla
actaactgcaaagggaatcgtatttcttgggcccccagctgcgtccatgggagctttgggtgataaaattggatcctctttgattgcgcaagcagcagatgttcctactcttccatggagtggctctcatgtgaaaattcctccagaaagttgtttgattaccatccccgatgacatatatagagaagcatgtgttcaca

SEQ ID NO: 2796 - DNA, 200 bp, Euphorbia heterophylla
tgtgaacacatgcttctctatatatgtcatcggggatggtaatcaaacaactttctggaggaattttcacatgagagccactccatggaagagtaggaacatctgctgcttgcgcaatcaaagaggatccaattttatcacccaaagctcccatggacgcagctgggggcccaagaaatacgattccctttgcagttagt

SEQ ID NO: 2797 - DNA, 200 bp, Euphorbia heterophylla
atatatagagaagcatgtgttcacacaacagaggaagctattgcaagctgccaagttgttggttaccctgctatgataaaggcatcatggggcggtggtggtaaaggcataagaaaggttcataatgatgatgaagttagggcattgtttaaacaagttcagggtgaagttccaggatcacccatatttataatgaaggt

SEQ ID NO: 2798 - DNA, 200 bp, Euphorbia heterophylla
accttcattataaatatgggtgatcctggaacttcaccctgaacttgtttaaacaatgccctaacttcatcatcattatgaacctttcttatgcctttaccaccaccgccccatgatgcctttatcatagcagggtaaccaacaacttggcagcttgcaatagcttcctctgttgtgtgaacacatgcttctctatatat

SEQ ID NO: 2799 - DNA, 200 bp, Euphorbia heterophylla
ttgacgggaggacttgcttgctacagaatgatcatgatccgtcaaagttagtggcagagacgccatgcaaacttctgagatatttggtttcagatggtagtcatattgaagctgatgctccatatgcagaggttgaagttatgaagatgtgcatgcctcttctttcacctgcttctggagttgtccattttaaaatgtct

SEQ ID NO: 2800 - DNA, 200 bp, Euphorbia heterophylla
agacattttaaaatggacaactccagaagcaggtgaaagaagaggcatgcacatcttcataacttcaacctctgcatatggagcatcagcttcaatatgactaccatctgaaaccaaatatctcagaagtttgcatggcgtctctgccactaactttgacggatcatgatcattctgtagcaagcaagtcctcccgtcaa

SEQ ID NO: 2801 - DNA, 200 bp, Euphorbia heterophylla
tggagttgtccattttaaaatgtctgaaggtcaagcaatgcaggctggggagctcattgcaaggcttgatcttgatgatccttctgctgtaagaaggcagaaccttttcatgggagattcccgctacttggctctcctactgctatttctggtaaagttcatcagagatgtgctgcaagtctaaatgcagcccgtatgat

SEQ ID NO: 2802 - DNA, 200 bp, Euphorbia heterophylla
atcatacgggctgcatttagacttgcagcacatctctgatgaactttaccagaaatagcagtaggagagccaagtagcgggaatctcccatgaaaaggttctgccttcttacagcagaaggatcatcaagatcaagccttgcaatgagctccccagcctgcattgcttgaccttcagacattttaaaatggacaactcca

SEQ ID NO: 2803 - DNA, 200 bp, Euphorbia heterophylla
caagtctaaatgcagcccgtatgattctcgctggctacgatcataatattgatgaagtagtgcaaaacttgctcaattgccttgatagtcctgaactccctttccttcagtggcaagagtgcttgtctgttctagcaactcgccttcccaaggatcttaggagcgagttggaatcaaaatacacagagtttgaaggaatt

SEQ ID NO: 2804 - DNA, 200 bp, Euphorbia heterophylla
aattccttcaaactctgtgtattttgattccaactcgctcctaagatccttgggaaggcgagttgctagaacagacaagcactcttgccactgaaggaaagggagttcaggactatcaaggcaattgagcaagttttgcactacttcatcaatattatgatcgtagccagcgagaatcatacgggctgcatttagacttg

SEQ ID NO: 2805 - DNA, 200 bp, Euphorbia heterophylla
aaaatacacagagtttgaaggaatttcgagctcccagaacattgacttccctgccaaactgttaaggggtgtcctcgaggcacacctgaaatcctgtcctgagaaagaaaaaggagcgttggaaaggcttgttgaacctttgatgagtcttgtaaagtcttatgagggaggacgtgagagtcatgctcgagtgatcgtcc

SEQ ID NO: 2806 - DNA, 200 bp, Euphorbia heterophylla
ggacgatcactcgagcatgactctcacgtcctccctcataagactttacaagactcatcaaaggttcaacaagcctttccaacgctcctttttctttctcaggacaggatttcaggtgtgcctcgaggacaccccttaacagtttggcagggaagtcaatgttctgggagctcgaaattccttcaaactctgtgtatttt

SEQ ID NO: 2807 - DNA, 200 bp, Euphorbia heterophylla
gagagtcatgctcgagtgatcgtccaatcactttttgaagagtatttatctgtagaagaattatttagtgacaacatccaggctgatgtgattgaacgtctcagacttcaatataagaaagaccttttgaagatagtggacattgtcctttctcatcagggtgttaagagtaaaaataagctgatactacggctcatgga

SEQ ID NO: 2808 - DNA, 200 bp, Euphorbia heterophylla
tccatgagccgtagtatcagcttatttttactcttaacaccctgatgagaaaggacaatgtccactatcttcaaaaggtctttcttatattgaagtctgagacgttcaatcacatcagcctggatgttgtcactaaataattcttctacagataaatactcttcaaaaagtgattggacgatcactcgagcatgactctc

SEQ ID NO: 2809 - DNA, 200 bp, Euphorbia heterophylla
ataagctgatactacggctcatggaacaacttgtttaccccaaccctgctgcatatagggataaactcattcggttctctcagcttaaccacaccagctattccgagttggcattgaaggcaagtcaactcctagaacaaaccaaactgagtgaactccgttccactattgctagaagcctttcggaattggagatgttt

SEQ ID NO: 2810 - DNA, 200 bp, Euphorbia heterophylla
aaacatctccaattccgaaaggcttctagcaatagtggaacggagttcactcagtttggtttgttctaggagttgacttgccttcaatgccaactcggaatagctggtgtggttaagctgagagaaccgaatgagtttatccctatatgcagcagggttggggtaaacaagttgttccatgagccgtagtatcagcttat

SEQ ID NO: 2811 - DNA, 200 bp, Euphorbia heterophylla
aagcctttcggaattggagatgtttaccgaggatggtgaaaatatggatactcccaaaaggaaaagtgccattaatgaacgtatggaggatcttgtgagtgctcctttggctgttgaagatgctttagtgggtcttttcgagcacagtgatcacacccttcaaaggcgagtggtggaaacttatgttcgtaggctatatc

SEQ ID NO: 2812 - DNA, 200 bp, Euphorbia heterophylla
gatatagcctacgaacataagtttccaccactcgcctttgaagggtgtgatcactgtgctcgaaaagacccactaaagcatcttcaacagccaaaggagcactcacaagatcctccatacgttcattaatggcacttttccttttgggagtatccatattttcaccatcctcggtaaacatctccaattccgaaaggctt

SEQ ID NO: 2813 - DNA, 200 bp, Euphorbia heterophylla; identical to SEQ ID NO: 2507

SEQ ID NO: 2814 - DNA, 200 bp, Euphorbia heterophylla; identical to SEQ ID NO: 2508

SEQ ID NO: 2815 - DNA, 200 bp, Euphorbia heterophylla; identical to SEQ ID NO: 2509

SEQ ID NO: 2816 - DNA, 200 bp, Euphorbia heterophylla; identical to SEQ ID NO: 2510

SEQ ID NO: 2817 - DNA, 200 bp, Euphorbia heterophylla; identical to SEQ ID NO: 2511

SEQ ID NO: 2818 - DNA, 200 bp, Euphorbia heterophylla; identical to SEQ ID NO: 2512

SEQ ID NO: 2819 - DNA, 200 bp, Euphorbia heterophylla; identical to SEQ ID NO: 2513

SEQ ID NO: 2820 - DNA, 200 bp, Euphorbia heterophylla; identical to SEQ ID NO: 2514

SEQ ID NO: 2821 - DNA, 200 bp, Euphorbia heterophylla; identical to SEQ ID NO: 2515

SEQ ID NO: 2822 - DNA, 200 bp, Euphorbia heterophylla; identical to SEQ ID NO: 2516

SEQ ID NO: 2823 - DNA, 200 bp, Euphorbia heterophylla; identical to SEQ ID NO: 2517

SEQ ID NO: 2824 - DNA, 200 bp, Euphorbia heterophylla; identical to SEQ ID NO: 2518

SEQ ID NO: 2825 - DNA, 200 bp, Euphorbia heterophylla; identical to SEQ ID NO: 2519

SEQ ID NO: 2826 - DNA, 200 bp, Euphorbia heterophylla; identical to SEQ ID NO: 2520

SEQ ID NO: 2827 - DNA, 200 bp, Euphorbia heterophylla; identical to SEQ ID NO: 2521

SEQ ID NO: 2828 - DNA, 200 bp, Euphorbia heterophylla; identical to SEQ ID NO: 2522

SEQ ID NO: 2829 - DNA, 200 bp, Euphorbia heterophylla; identical to SEQ ID NO: 2523

SEQ ID NO: 2830 - DNA, 200 bp, Euphorbia heterophylla; identical to SEQ ID NO: 2524

SEQ ID NO: 2831 - DNA, 200 bp, Euphorbia heterophylla; identical to SEQ ID NO: 2525

SEQ ID NO: 2832 - DNA, 200 bp, Euphorbia heterophylla; identical to SEQ ID NO: 2526

SEQ ID NO: 2833 - DNA, 200 bp, Euphorbia heterophylla; identical to SEQ ID NO: 2527

SEQ ID NO: 2834 - DNA, 200 bp, Euphorbia heterophylla; identical to SEQ ID NO: 2528

SEQ ID NO: 2835 - DNA, 200 bp, Euphorbia heterophylla
taaaggcataagaaaggtttggcttcgatataacaaatttccgagtgtagtgttcaagtctgtagtgtacgatggctgagttttgttttcttggattatctaggttcataatgatgatgaagttagggcattgtttaaacaagttcagggtgaagttccaggatcacccatatttataatgaaggttgcttcccaggtta

SEQ ID NO: 2836 - DNA, 200 bp, Euphorbia heterophylla
taacctgggaagcaaccttcattataaatatgggtgatcctggaacttcaccctgaacttgtttaaacaatgccctaacttcatcatcattatgaacctagataatccaagaaaacaaaactcagccatcgtacactacagacttgaacactacactcggaaatttgttatatcgaagccaaacctttcttatgccttta

SEQ ID NO: 2837 - DNA, 200 bp, Euphorbia heterophylla
ataatgaaggttgcttcccaggttaggatattatctagcttctaatttgatacaagagattttactttgtgattcttgacgcgtgaatcgaattctgatgatctatttgattttccttatgtagagtcgacatttagaagtccaattgctctgcgatcaatatggaaatgtagcagctttgcatagccgtgattgtagtg

SEQ ID NO: 2838 - DNA, 200 bp, Euphorbia heterophylla
cactacaatcacggctatgcaaagctgctacatttccatattgatcgcagagcaattggacttctaaatgtcgactctacataaggaaaatcaaatagatcatcagaattcgattcacgcgtcaagaatcacaaagtaaaatctcttgtatcaaattagaagctagataatatcctaacctgggaagcaaccttcattat

SEQ ID NO: 2839 - DNA, 200 bp, Euphorbia heterophylla; identical to SEQ ID NO: 2533

SEQ ID NO: 2840 - DNA, 200 bp, Euphorbia heterophylla; identical to SEQ ID NO: 2534

SEQ ID NO: 2841 - DNA, 200 bp, Euphorbia heterophylla; identical to SEQ ID NO: 2535

SEQ ID NO: 2842 - DNA, 200 bp, Euphorbia heterophylla; identical to SEQ ID NO: 2536

SEQ ID NO: 2843 - DNA, 200 bp, Euphorbia heterophylla; identical to SEQ ID NO: 2537

SEQ ID NO: 2844 - DNA, 200 bp, Euphorbia heterophylla; identical to SEQ ID NO: 2538

SEQ ID NO: 2845 - DNA, 200 bp, Euphorbia heterophylla; identical to SEQ ID NO: 2539

SEQ ID NO: 2846 - DNA, 200 bp, Euphorbia heterophylla; identical to SEQ ID NO: 2540

SEQ ID NO: 2847 - DNA, 200 bp, Euphorbia heterophylla; identical to SEQ ID NO: 2541

SEQ ID NO: 2848 - DNA, 200 bp, Euphorbia heterophylla; identical to SEQ ID NO: 2542

SEQ ID NO: 2849 - DNA, 200 bp, Euphorbia heterophylla; identical to SEQ ID NO: 2543

SEQ ID NO: 2850 - DNA, 200 bp, Euphorbia heterophylla; identical to SEQ ID NO: 2544

SEQ ID NO: 2851 - DNA, 200 bp, Euphorbia heterophylla; identical to SEQ ID NO: 2545

SEQ ID NO: 2852 - DNA, 200 bp, Euphorbia heterophylla; identical to SEQ ID NO: 2546

SEQ ID NO: 2853 - DNA, 200 bp, Euphorbia heterophylla; identical to SEQ ID NO: 2547

SEQ ID NO: 2854 - DNA, 200 bp, Euphorbia heterophylla; identical to SEQ ID NO: 2548

SEQ ID NO: 2855 - DNA, 200 bp, Euphorbia heterophylla; identical to SEQ ID NO: 2549

SEQ ID NO: 2856 - DNA, 200 bp, Euphorbia heterophylla; identical to SEQ ID NO: 2550

SEQ ID NO: 2857 - DNA, 200 bp, Euphorbia heterophylla; identical to SEQ ID NO: 2551

SEQ ID NO: 2858 - DNA, 200 bp, Euphorbia heterophylla; identical to SEQ ID NO: 2552

SEQ ID NO: 2859 - DNA, 200 bp, Euphorbia heterophylla; identical to SEQ ID NO: 2553

SEQ ID NO: 2860 - DNA, 200 bp, Euphorbia heterophylla; identical to SEQ ID NO: 2554

SEQ ID NO: 2861 - DNA, 200 bp, Euphorbia heterophylla; identical to SEQ ID NO: 2555

SEQ ID NO: 2862 - DNA, 200 bp, Euphorbia heterophylla; identical to SEQ ID NO: 2556

SEQ ID NO: 2863 - DNA, 200 bp, Euphorbia heterophylla; identical to SEQ ID NO: 2557

SEQ ID NO: 2864 - DNA, 200 bp, Euphorbia heterophylla; identical to SEQ ID NO: 2558

SEQ ID NO: 2865 - DNA, 200 bp, Euphorbia heterophylla; identical to SEQ ID NO: 2559

SEQ ID NO: 2866 - DNA, 200 bp, Euphorbia heterophylla; identical to SEQ ID NO: 2560

SEQ ID NO: 2867 - DNA, 200 bp, Euphorbia heterophylla; identical to SEQ ID NO: 2561

SEQ ID NO: 2868 - DNA, 200 bp, Euphorbia heterophylla; identical to SEQ ID NO: 2562

SEQ ID NO: 2869 - DNA, 200 bp, Euphorbia heterophylla; identical to SEQ ID NO: 2563

SEQ ID NO: 2870 - DNA, 200 bp, Euphorbia heterophylla; identical to SEQ ID NO: 2564

SEQ ID NO: 2871 - DNA, 200 bp, Euphorbia heterophylla; identical to SEQ ID NO: 2565

SEQ ID NO: 2872 - DNA, 200 bp, Euphorbia heterophylla; identical to SEQ ID NO: 2566

SEQ ID NO: 2873 - DNA, 200 bp, Euphorbia heterophylla; identical to SEQ ID NO: 2567

SEQ ID NO: 2874 - DNA, 200 bp, Euphorbia heterophylla; identical to SEQ ID NO: 2568

SEQ ID NO: 2875 - DNA, 200 bp, Euphorbia heterophylla; identical to SEQ ID NO: 2569

SEQ ID NO: 2876 - DNA, 200 bp, Euphorbia heterophylla; identical to SEQ ID NO: 2570

SEQ ID NO: 2877 - DNA, 200 bp, Euphorbia heterophylla; identical to SEQ ID NO: 2571

SEQ ID NO: 2878 - DNA, 200 bp, Euphorbia heterophylla; identical to SEQ ID NO: 2572

SEQ ID NO: 2879 - DNA, 200 bp, Euphorbia heterophylla; identical to SEQ ID NO: 2573

SEQ ID NO: 2880 - DNA, 200 bp, Euphorbia heterophylla; identical to SEQ ID NO: 2574

SEQ ID NO: 2881 - DNA, 200 bp, Euphorbia heterophylla; identical to SEQ ID NO: 2575

SEQ ID NO: 2882 - DNA, 200 bp, Euphorbia heterophylla; identical to SEQ ID NO: 2576

SEQ ID NO: 2883 - DNA, 200 bp, Euphorbia heterophylla; identical to SEQ ID NO: 2577

SEQ ID NO: 2884 - DNA, 200 bp, Euphorbia heterophylla; identical to SEQ ID NO: 2578

SEQ ID NO: 2885 - DNA, 200 bp, Euphorbia heterophylla; identical to SEQ ID NO: 2579

SEQ ID NO: 2886 - DNA, 200 bp, Euphorbia heterophylla; identical to SEQ ID NO: 2580

SEQ ID NO: 2887 - DNA, 200 bp, Euphorbia heterophylla; identical to SEQ ID NO: 2581

SEQ ID NO: 2888 - DNA, 200 bp, Euphorbia heterophylla; identical to SEQ ID NO: 2582

SEQ ID NO: 2889 - DNA, 200 bp, Euphorbia heterophylla; identical to SEQ ID NO: 2583

SEQ ID NO: 2890 - DNA, 200 bp, Euphorbia heterophylla; identical to SEQ ID NO: 2584

SEQ ID NO: 2891 - DNA, 200 bp, Euphorbia heterophylla; identical to SEQ ID NO: 2585

SEQ ID NO: 2892 - DNA, 200 bp, Euphorbia heterophylla; identical to SEQ ID NO: 2586

SEQ ID NO: 2893 - DNA, 200 bp, Euphorbia heterophylla; identical to SEQ ID NO: 2587

SEQ ID NO: 2894 - DNA, 200 bp, Euphorbia heterophylla; identical to SEQ ID NO: 2588

SEQ ID NO: 2895 - DNA, 200 bp, Euphorbia heterophylla; identical to SEQ ID NO: 2589

SEQ ID NO: 2896 - DNA, 200 bp, Euphorbia heterophylla; identical to SEQ ID NO: 2590

SEQ ID NO: 2897 - DNA, 200 bp, Euphorbia heterophylla; identical to SEQ ID NO: 2591

SEQ ID NO: 2898 - DNA, 200 bp, Euphorbia heterophylla; identical to SEQ ID NO: 2592

SEQ ID NO: 2899 - DNA, 200 bp, Euphorbia heterophylla; identical to SEQ ID NO: 2593

SEQ ID NO: 2900 - DNA, 200 bp, Euphorbia heterophylla; identical to SEQ ID NO: 2594

SEQ ID NO: 2901 - DNA, 200 bp, Euphorbia heterophylla; identical to SEQ ID NO: 2595

SEQ ID NO: 2902 - DNA, 200 bp, Euphorbia heterophylla; identical to SEQ ID NO: 2596

SEQ ID NO: 2903 - DNA, 200 bp, Euphorbia heterophylla; identical to SEQ ID NO: 2597

SEQ ID NO: 2904 - DNA, 200 bp, Euphorbia heterophylla; identical to SEQ ID NO: 2598

SEQ ID NO: 2905 - DNA, 200 bp, Euphorbia heterophylla; identical to SEQ ID NO: 2599

SEQ ID NO: 2906 - DNA, 200 bp, Euphorbia heterophylla; identical to SEQ ID NO: 2600

SEQ ID NO: 2907 - DNA, 200 bp, Euphorbia heterophylla; identical to SEQ ID NO: 2601

SEQ ID NO: 2908 - DNA, 200 bp, Euphorbia heterophylla; identical to SEQ ID NO: 2602

SEQ ID NO: 2909 - DNA, 200 bp, Euphorbia heterophylla; identical to SEQ ID NO: 2603

SEQ ID NO: 2910 - DNA, 200 bp, Euphorbia heterophylla; identical to SEQ ID NO: 2604

SEQ ID NO: 2911 - DNA, 200 bp, Euphorbia heterophylla; identical to SEQ ID NO: 2605

SEQ ID NO: 2912 - DNA, 200 bp, Euphorbia heterophylla; identical to SEQ ID NO: 2606

SEQ ID NO: 2913 - DNA, 200 bp, Euphorbia heterophylla; identical to SEQ ID NO: 2607

SEQ ID NO: 2914 - DNA, 200 bp, Euphorbia heterophylla; identical to SEQ ID NO: 2608

SEQ ID NO: 2915 - DNA, 200 bp, Euphorbia heterophylla; identical to SEQ ID NO: 2609

SEQ ID NO: 2916 - DNA, 200 bp, Euphorbia heterophylla; identical to SEQ ID NO: 2610

SEQ ID NO: 2917 - DNA, 200 bp, Euphorbia heterophylla; identical to SEQ ID NO: 2611

SEQ ID NO: 2918 - DNA, 200 bp, Euphorbia heterophylla; identical to SEQ ID NO: 2612

SEQ ID NO: 2919 - DNA, 200 bp, Euphorbia heterophylla; identical to SEQ ID NO: 2613

SEQ ID NO: 2920 - DNA, 200 bp, Euphorbia heterophylla; identical to SEQ ID NO: 2614

SEQ ID NO: 2921 - DNA, 200 bp, Euphorbia heterophylla; identical to SEQ ID NO: 2615

SEQ ID NO: 2922 - DNA, 200 bp, Euphorbia heterophylla; identical to SEQ ID NO: 2616

SEQ ID NO: 2923 - DNA, 200 bp, Euphorbia heterophylla; identical to SEQ ID NO: 2617

SEQ ID NO: 2924 - DNA, 200 bp, Euphorbia heterophylla; identical to SEQ ID NO: 2618

SEQ ID NO: 2925 - DNA, 200 bp, Euphorbia heterophylla; identical to SEQ ID NO: 2619

SEQ ID NO: 2926 - DNA, 200 bp, Euphorbia heterophylla; identical to SEQ ID NO: 2620

SEQ ID NO: 2927 - DNA, 200 bp, Euphorbia heterophylla
cgacgtgggcatggtagcatggtgcatggaaatgttcaccccggaatgcccttccggaaggaaaatcttgatagtagcgaacgacgtgaccttcaaagccgggtctttcggcccgagagaggatgcattcttttccgccataaccgatcttgcatgcaccaaaaagctccctttagtctacctggcagcaaactctggtg

SEQ ID NO: 2928 - DNA, 200 bp, Euphorbia heterophylla
caccagagtttgctgccaggtagactaaagggagctttttggtgcatgcaagatcggttatggcggaaaagaatgcatcctctctcgggccgaaagacccggctttgaaggtcacgtcgttcgctactatcaagattttccttccggaagggcattccggggtgaacatttccatgcaccatgctaccatgcccacgtcg

SEQ ID NO: 2929 - DNA, 200 bp, Euphorbia heterophylla
gtctacctggcagcaaactctggtgctcgtataggtgttgccgaggaagtcaagtcttgctttaaagtcggttggtcagatgagtcatctcccgagcgtggtttccagtacgtatatttgactcccgaggattatgtaaccattggatcatcggtgatagcacacgagctgaatcagaatggagaaacacggtgggtcat

SEQ ID NO: 2930 - DNA, 200 bp, Euphorbia heterophylla
atgacccaccgtgtttctccattctgattcagctcgtgtgctatcaccgatgatccaatggttacataatcctcgggagtcaaatatacgtactggaaaccacgctcgggagatgactcatctgaccaaccgactttaaagcaagacttgacttcctcggcaacacctatacgagcaccagagtttgctgccaggtagac

SEQ ID NO: 2931 - DNA, 200 bp, Euphorbia heterophylla
agaatggagaaacacggtgggtcatagatgccattgttgggaaagaggatggcttaggtgtcgaaaatttatcgggaagtggagccattgctagtgcatactcaagggcatataaggaaaccttcacattgacatacgtaactggaagaacagtgggaatcggtgcttacctggcacgcctcgggatgagatgcatacaa

SEQ ID NO: 2932 - DNA, 200 bp, Euphorbia heterophylla
ttgtatgcatctcatcccgaggcgtgccaggtaagcaccgattcccactgttcttccagttacgtatgtcaatgtgaaggtttccttatatgcccttgagtatgcactagcaatggctccacttcccgataaattttcgacacctaagccatcctctttcccaacaatggcatctatgacccaccgtgtttctccattct

SEQ ID NO: 2933 - DNA, 200 bp, Euphorbia heterophylla
acgcctcgggatgagatgcatacaacggctcgatcaaccgatcatcttgaccgggttctccgcgttaaacaaactcctcggccgtgaagtgtatagctctcacatgcaactcggcggtccgaaaattatggccaccaatggggtagtccatcgcaccgtctccgatgacctcgaaggtatttcggaaatcctgaaatggc

SEQ ID NO: 2934 - DNA, 200 bp, Euphorbia heterophylla
gccatttcaggatttccgaaataccttcgaggtcatcggagacggtgcgatggactaccccattggtggccataattttcggaccgccgagttgcatgtgagagctatacacttcacggccgaggagtttgtttaacgcggagaacccggtcaagatgatcggttgatcgagccgttgtatgcatctcatcccgaggcgt

SEQ ID NO: 2935 - DNA, 200 bp, Euphorbia heterophylla
ggtatttcggaaatcctgaaatggctaagctgtattccccctcaaagcggcggggcaattccggtatttccttctccggatcctccggagcgacccgtggagtacttcccagaaacatcgtgcgacccgcgggcggccatctcgggtacaatggacggcagcgggaagaagtggctcgggggtattttcgacaaagacag

SEQ ID NO: 2936 - DNA, 200 bp, Euphorbia heterophylla
ctgtctttgtcgaaaatacccccgagccacttcttcccgctgccgtccattgtacccgagatggccgcccgcgggtcgcacgatgtttctgggaagtactccacgggtcgctccggaggatccggagaaggaaataccggaattgccccgccgctttgagggggaatacagcttagccatttcaggatttccgaaatacc

SEQ ID NO: 2937 - DNA, 200 bp, Euphorbia heterophylla
tcgggggtattttcgacaaagacagcttcgtggagacactggaagggtgggcgaggaccgtggtgaccgggcgggcaaagctcggggggattccggttgggataatagccgtcgagactcaaaccgtgatgcaagtgatccccgccgacccgggccagctggactcgcacgagcgggtcgtgccccaggcgggtcaagta

SEQ ID NO: 2938 - DNA, 200 bp, Euphorbia heterophylla
tacttgacccgcctggggcacgacccgctcgtgcgagtccagctggcccgggtcggcggggatcacttgcatcacggtttgagtctcgacggctattatcccaaccggaatccccccgagctttgcccgcccggtcaccacggtcctcgcccacccttccagtgtctccacgaagctgtctttgtcgaaaatacccccga

SEQ ID NO: 2939 - DNA, 200 bp, Euphorbia heterophylla
ggtcgtgccccaggcgggtcaagtatggttcccagattcggcgaataaaaccgcccaagcgattatggatttcaaccgagaagagctcccgctctttatcctcgccaactggcgaggcttctcgggcggccaacgagacctcttcgaaggtatcctacaggcggggtccaccatagtggaaaacttaaggacatataacc

SEQ ID NO: 2940 - DNA, 200 bp, Euphorbia heterophylla
ggttatatgtccttaagttttccactatggtggaccccgcctgtaggataccttcgaagaggtctcgttggccgcccgagaagcctcgccagttggcgaggataaagagcgggagctcttctcggttgaaatccataatcgcttgggcggttttattcgccgaatctgggaaccatacttgacccgcctggggcacgacc

SEQ ID NO: 2941 - DNA, 200 bp, Euphorbia heterophylla
gtggaaaacttaaggacatataaccaaccggttttcgtatacatccctatgatgggcgagcttcgtggtggggcctgggttgttgtggacagtcagataaattccgaccacatcgagatgtacgctgatcggacggctaaaggcaacgtccttgaaccggaaggaataatcgagatcaagtttagaacaaaggagttgct

SEQ ID NO: 2942 - DNA, 200 bp, Euphorbia heterophylla
agcaactcctttgttctaaacttgatctcgattattccttccggttcaaggacgttgcctttagccgtccgatcagcgtacatctcgatgtggtcggaatttatctgactgtccacaacaacccaggccccaccacgaagctcgcccatcatagggatgtatacgaaaaccggttggttatatgtccttaagttttccac

SEQ ID NO: 2943 - DNA, 200 bp, Euphorbia heterophylla
tcaagtttagaacaaaggagttgctcgattgcatgaatcgactcgacccaaagctgatatctttaaaaaccaaactaaccgaagcgaagaatagtgggacctacgggatggtcgattccgtacaacagctgataaaatcccgggaaaagcaacttctgccgctttacacgcaaatcgccacacgattcgccgagcttcac

SEQ ID NO: 2944 - DNA, 200 bp, Euphorbia heterophylla
gtgaagctcggcgaatcgtgtggcgatttgcgtgtaaagcggcagaagttgcttttcccgggattttatcagctgttgtacggaatcgaccatcccgtaggtcccactattcttcgcttcggttagtttggtttttaaagatatcagctttgggtcgagtcgattcatgcaatcgagcaactcctttgttctaaacttga

SEQ ID NO: 2945 - DNA, 200 bp, Euphorbia heterophylla
cgccacacgattcgccgagcttcacgactcggctttacgaatggcggcaaagggggtgattcgagaagttgtcgactgggggatttcacgatcttacttctacaaaaggttaagaaggagaatcgccgaggcttcgttggtgaacaccgtgaaagatgcagcgggtgataagctccagcataagtcggctatggagttgg

SEQ ID NO: 2946 - DNA, 200 bp, Euphorbia heterophylla
ccaactccatagccgacttatgctggagcttatcacccgctgcatctttcacggtgttcaccaacgaagcctcggcgattctccttcttaaccttttgtagaagtaagatcgtgaaatcccccagtcgacaacttctcgaatcaccccctttgccgccattcgtaaagccgagtcgtgaagctcggcgaatcgtgtggcg

SEQ ID NO: 2947 - DNA, 200 bp, Euphorbia heterophylla
cagcataagtcggctatggagttggtcaaaaactggtttctggactcgaaaggcgattgggaaaacgatgaagctttctatgcttggaaggataatcccgcgaattacgaggaaaagctacaggagttacgggtccagaaggtgttgcttcagttaactaacattggcgagtctttgtcggatttgaaagctttacctca

SEQ ID NO: 2948 - DNA, 200 bp, Euphorbia heterophylla
tgaggtaaagctttcaaatccgacaaagactcgccaatgttagttaactgaagcaacaccttctggacccgtaactcctgtagcttttcctcgtaattcgcgggattatccttccaagcatagaaagcttcatcgttttcccaatcgcctttcgagtccagaaaccagtttttgaccaactccatagccgacttatgctg

SEQ ID NO: 2949 - DNA, 200 bp, Euphorbia heterophylla
tgtcggatttgaaagctttacctcaaggtcttgctgcccttctaaataaggtaattttttgggttttttcttccaggaatattgtttatttagacgatcgagtcggatgttatgtaatactttatgtttgatgtaggtggagccatcgagccgaggggcgttgatcgatgagcttcggaaggtgcttaattgattttcgg

SEQ ID NO: 2950 - DNA, 200 bp, Euphorbia heterophylla
ccgaaaatcaattaagcaccttccgaagctcatcgatcaacgcccctcggctcgatggctccacctacatcaaacataaagtattacataacatccgactcgatcgtctaaataaacaatattcctggaagaaaaaacccaaaaaattaccttatttagaagggcagcaagaccttgaggtaaagctttcaaatccgaca

SEQ ID NO: 2951 - DNA, 200 bp, Euphorbia heterophylla
cggaaggtgcttaattgattttcggtaagtgtttctcggctactaaatatgttttactttggcttcagtctctgggtagtttgaatcaatagaaaatgccaatgtgaaaatacccagtaatatatttgataagtgtaaatgtaactattattatatttaagtgaatagggggaattagttcatatgattattgttgttat

SEQ ID NO: 2952 - DNA, 200 bp, Euphorbia heterophylla
ataacaacaataatcatatgaactaattccccctattcacttaaatataataatagttacatttacacttatcaaatatattactgggtattttcacattggcattttctattgattcaaactacccagagactgaagccaaagtaaaacatatttagtagccgagaaacacttaccgaaaatcaattaagcaccttccg

SEQ ID NO: 2953 - DNA, 200 bp, Euphorbia heterophylla
tagttcatatgattattgttgttataaacaaatcagagatagagagagctatatttattattatatttgcgaattaaagttattaggagtagtataatttggcggttgttgcattttacgtgtaatgatctgaatgttgtttgttcgtgattattgaataaaagggcatcaaatgccataatttatctttctttgttaac

SEQ ID NO: 2954 - DNA, 200 bp, Euphorbia heterophylla
gttaacaaagaaagataaattatggcatttgatgcccttttattcaataatcacgaacaaacaacattcagatcattacacgtaaaatgcaacaaccgccaaattatactactcctaataactttaattcgcaaatataataataaatatagctctctctatctctgatttgtttataacaacaataatcatatgaacta

SEQ ID NO: 2955 - DNA, 200 bp, Kochia scoparia
aatagtaaaaacctagtgaactttgtagtttgtagtttgtagtgtgcagtgtgcagtgtgcagtgtcgcattaaaatttgactaatgctaatgcttccctaaaatctctcctaaacatgtgaatttccttaaattaccaccgcaaactccattcaatacttagaattattcccttgaattcgatcctactcttcagtttc

SEQ ID NO: 2956 - DNA, 200 bp, Kochia scoparia
gaaactgaagagtaggatcgaattcaagggaataattctaagtattgaatggagtttgcggtggtaatttaaggaaattcacatgtttaggagagattttagggaagcattagcattagtcaaattttaatgcgacactgcacactgcacactgcacactacaaactacaaactacaaagttcactaggtttttactatt

SEQ ID NO: 2957 - DNA, 200 bp, Kochia scoparia
gaattcgatcctactcttcagtttcatagtttcaacactcttttatttaaacttcctacaatcgtcgttctcttttttttttttgtttttcctaggcttcaaatgcagtattattattattattattagtttttcttattttacaactaaattttcatttcaacactcagaaaatttaagatgattccaatttctgagcg

SEQ ID NO: 2958 - DNA, 200 bp, Kochia scoparia
cgctcagaaattggaatcatcttaaattttctgagtgttgaaatgaaaatttagttgtaaaataagaaaaactaataataataataataatactgcatttgaagcctaggaaaaacaaaaaaaaaaaagagaacgacgattgtaggaagtttaaataaaagagtgttgaaactatgaaactgaagagtaggatcgaattc

SEQ ID NO: 2959 - DNA, 200 bp, Kochia scoparia
ttaagatgattccaatttctgagcgttgtcatgttgttaaatttcctatactcaaatcttcttctcattgccgtctcttatttcacagtgcaaatgggactatgaaatttcaactcaaaaagaggtattttcattttcatttcttagtgtcgtattttcgtaattacgttgatttttgtgtgaattgtatactagtatta

SEQ ID NO: 2960 - DNA, 200 bp, Kochia scoparia
taatactagtatacaattcacacaaaaatcaacgtaattacgaaaatacgacactaagaaatgaaaatgaaaatacctctttttgagttgaaatttcatagtcccatttgcactgtgaaataagagacggcaatgagaagaagatttgagtataggaaatttaacaacatgacaacgctcagaaattggaatcatcttaa

SEQ ID NO: 2961 - DNA, 200 bp, Kochia scoparia
ttgtgtgaattgtatactagtattacaaaggatccatgattacatcgttcaattggcatagatgatgaaattgttataaatatcgtgcaatttgcaatgcttgctttcatgattatttgtgttgttgaagggaaattcttaatcaatctcgagatatgtatatcgggtgacattttcgtaaatgaacaaaaaaccttcaa

SEQ ID NO: 2962 - DNA, 200 bp, Kochia scoparia
ttgaaggttttttgttcatttacgaaaatgtcacccgatatacatatctcgagattgattaagaatttcccttcaacaacacaaataatcatgaaagcaagcattgcaaattgcacgatatttataacaatttcatcatctatgccaattgaacgatgtaatcatggatcctttgtaatactagtatacaattcacacaa

SEQ ID NO: 2963 - DNA, 200 bp, Kochia scoparia
tcgtaaatgaacaaaaaaccttcaaggaatttattttcactttatttacgagaatatacatagcttgagattgtttaagaaattctcgatttggaggtatcacttagattgtttaatttcattattttaatcatggaaaacgatatattctcgctaactcgcatttgaattcacaacttttgtacattgtagctttcttt

SEQ ID NO: 2964 - DNA, 200 bp, Kochia scoparia
aaagaaagctacaatgtacaaaagttgtgaattcaaatgcgagttagcgagaatatatcgttttccatgattaaaataatgaaattaaacaatctaagtgatacctccaaatcgagaatttcttaaacaatctcaagctatgtatattctcgtaaataaagtgaaaataaattccttgaaggttttttgttcatttacga

SEQ ID NO: 2965 - DNA, 200 bp, Kochia scoparia
acttttgtacattgtagctttctttctaggatgcataaagaacttgacactaccaactaaccggtgtttacgatgaatcatacccttttctttgagctgattttgggatgtgtcttttatattggggttggtttttggtagtgtgcagttgagctaaataaaagctctctttggtaagacgtaaatttttttgatgcaaa

SEQ ID NO: 2966 - DNA, 200 bp, Kochia scoparia
tttgcatcaaaaaaatttacgtcttaccaaagagagcttttatttagctcaactgcacactaccaaaaaccaaccccaatataaaagacacatcccaaaatcagctcaaagaaaagggtatgattcatcgtaaacaccggttagttggtagtgtcaagttctttatgcatcctagaaagaaagctacaatgtacaaaagt

SEQ ID NO: 2967 - DNA, 200 bp, Kochia scoparia
aagacgtaaatttttttgatgcaaagtgttttcgacaattttctaattttatattgtttggttgacaaaggagtataaaaccattttacatggtaaacttttccttcaatattttgtacactcttctggctacctctttgcactccttcattttcgctattttccatattgtttatgatgcaatcaaataatggaaaatt

SEQ ID NO: 2968 - DNA, 200 bp, Kochia scoparia
aattttccattatttgattgcatcataaacaatatggaaaatagcgaaaatgaaggagtgcaaagaggtagccagaagagtgtacaaaatattgaaggaaaagtttaccatgtaaaatggttttatactcctttgtcaaccaaacaatataaaattagaaaattgtcgaaaacactttgcatcaaaaaaatttacgtctt

SEQ ID NO: 2969 - DNA, 200 bp, Kochia scoparia
tgatgcaatcaaataatggaaaattgcttccatgtaaattgctttccattgtaaattgttttccttgaaaatcattttacattgaaaatattttacgccaaaccaaaatgaccctaggagtaatatagtgtgaatttatcatattgttatattcggtaatgcatactagataattgtggttcattttagttgttacttac

SEQ ID NO: 2970 - DNA, 200 bp, Kochia scoparia
gtaagtaacaactaaaatgaaccacaattatctagtatgcattaccgaatataacaatatgataaattcacactatattactcctagggtcattttggtttggcgtaaaatattttcaatgtaaaatgattttcaaggaaaacaatttacaatggaaagcaatttacatggaagcaattttccattatttgattgcatca

SEQ ID NO: 2971 - DNA, 200 bp, Kochia scoparia
gtggttcattttagttgttacttactcttctaactgttgagtgattaatacaagtatgtgtggtccaaagtatttatattttttaaaattaaaaaaaattgcattagattgttggctcttgaattctacttgactcttgaatgtatgagtcaaaataaaacaattattagtatgtagcttttataccataatagttctgc

SEQ ID NO: 2972 - DNA, 200 bp, Kochia scoparia
gcagaactattatggtataaaagctacatactaataattgttttattttgactcatacattcaagagtcaagtagaattcaagagccaacaatctaatgcaattttttttaattttaaaaaatataaatactttggaccacacatacttgtattaatcactcaacagttagaagagtaagtaacaactaaaatgaaccac

SEQ ID NO: 2973 - DNA, 200 bp, Kochia scoparia
agcttttataccataatagttctgcatttcaaacaaccgtatgttctattccttttagtataaattaattctctctttctctgttaatattgtagttgtgttgtaaaatatgttaattacccaattaaaaagctgcaatcttgcaataatatgagtattgcttatgatagtagctcatgtgtttcaaagcttgtatcatt

SEQ ID NO: 2974 - DNA, 200 bp, Kochia scoparia
aatgatacaagctttgaaacacatgagctactatcataagcaatactcatattattgcaagattgcagctttttaattgggtaattaacatattttacaacacaactacaatattaacagagaaagagagaattaatttatactaaaaggaatagaacatacggttgtttgaaatgcagaactattatggtataaaagct

SEQ ID NO: 2975 - DNA, 200 bp, Kochia scoparia
catgtgtttcaaagcttgtatcattttagtaagactatttgttttatgtaatactaggttgttgtagcttgcttgcttttgatatgtagaatatgcatatcgtgtgaaaattgggaatgctattcatgtgataagttactcgtactctttcatttatctcacgtgggctgtgtcgacacgacttgtgtcggacaacaccg

SEQ ID NO: 2976 - DNA, 200 bp, Kochia scoparia
cggtgttgtccgacacaagtcgtgtcgacacagcccacgtgagataaatgaaagagtacgagtaacttatcacatgaatagcattcccaattttcacacgatatgcatattctacatatcaaaagcaagcaagctacaacaacctagtattacataaaacaaatagtcttactaaaatgatacaagctttgaaacacatg

SEQ ID NO: 2977 - DNA, 200 bp, Kochia scoparia
acacgacttgtgtcggacaacaccgatacgcgatacttcaatcttttaacttagaacactacttttttcaagaaaatgggcgagtccgattcttggacaccaatgtctaatttgacacttcatccaactccaagtaacatagttcatgtgatatgatgtgattagcatgctgatcagtgttttattagatgatattgatt

SEQ ID NO: 2978 - DNA, 200 bp, Kochia scoparia
aatcaatatcatctaataaaacactgatcagcatgctaatcacatcatatcacatgaactatgttacttggagttggatgaagtgtcaaattagacattggtgtccaagaatcggactcgcccattttcttgaaaaaagtagtgttctaagttaaaagattgaagtatcgcgtatcggtgttgtccgacacaagtcgtgt

SEQ ID NO: 2979 - DNA, 200 bp, Kochia scoparia
agtgttttattagatgatattgattcaacatattggtgtaacagttataggaaaagtggacgtattttttgccaagggcagggcggaatgttatctagggaagacccaaataaggcaactccggagggaaaaattgattaccccaacagaacaactcttttgaggaaatctgctacattacccgttgttgatgaattttg

SEQ ID NO: 2980 - DNA, 200 bp, Kochia scoparia
caaaattcatcaacaacgggtaatgtagcagatttcctcaaaagagttgttctgttggggtaatcaatttttccctccggagttgccttatttgggtcttccctagataacattccgccctgcccttggcaaaaaatacgtccacttttcctataactgttacaccaatatgttgaatcaatatcatctaataaaacact

SEQ ID NO: 2981 - DNA, 200 bp, Kochia scoparia
cattacccgttgttgatgaattttgttatgctcttggagggaaaaagccgattcatagtattttgattgccaacaatggaatggcagctgttaaatttatcagaagtgttcggacatgggcttacgaaacttttggaacagagaaggctattgtattagtagcaatggctactccagaagacatgagaatcaacgctgaa

SEQ ID NO: 2982 - DNA, 200 bp, Kochia scoparia
ttcagcgttgattctcatgtcttctggagtagccattgctactaatacaatagccttctctgttccaaaagtttcgtaagcccatgtccgaacacttctgataaatttaacagctgccattccattgttggcaatcaaaatactatgaatcggctttttccctccaagagcataacaaaattcatcaacaacgggtaatg

SEQ ID NO: 2983 - DNA, 200 bp, Kochia scoparia
agaagacatgagaatcaacgctgaacacattcgaatggctgaccagtttgttgaggttcctggtgggactaacaacaacaactatgccaatgtacagctcattgttgaggtaaatcctgctttagtaacactgatcttccgtgttttctctgttagattacgaaatactcacattagccacagtgtatgagaaaagatat

SEQ ID NO: 2984 - DNA, 200 bp, Kochia scoparia
atatcttttctcatacactgtggctaatgtgagtatttcgtaatctaacagagaaaacacggaagatcagtgttactaaagcaggatttacctcaacaatgagctgtacattggcatagttgttgttgttagtcccaccaggaacctcaacaaactggtcagccattcgaatgtgttcagcgttgattctcatgtcttct

SEQ ID NO: 2985 - DNA, 200 bp, Kochia scoparia
agccacagtgtatgagaaaagatatcacctgtcctgttggcctgttgatgttcatcattgatttcagaggataaaattttgttaaaaagacttcaatttattttcactgctctttcagatggcagaaattacacgcgtagatgcagtttggccaggttggggacatgcatctgagatccctgagcttccagatgcactaa

SEQ ID NO: 2986 - DNA, 200 bp, Kochia scoparia
ttagtgcatctggaagctcagggatctcagatgcatgtccccaacctggccaaactgcatctacgcgtgtaatttctgccatctgaaagagcagtgaaaataaattgaagtctttttaacaaaattttatcctctgaaatcaatgatgaacatcaacaggccaacaggacaggtgatatcttttctcatacactgtggct

SEQ ID NO: 2987 - DNA, 200 bp, Kochia scoparia
atccctgagcttccagatgcactaaccgcaaaggggattgaatttctagggcctccagctatatctatggctgctcttggagacaaaatcggttcatcattgattgctcaggccgcagatgttccaactcttccatggagtggctctcatgtatgaattgattttcttatcgaccttcacaaactttctttttctcaagg

SEQ ID NO: 2988 - DNA, 200 bp, Kochia scoparia
ccttgagaaaaagaaagtttgtgaaggtcgataagaaaatcaattcatacatgagagccactccatggaagagttggaacatctgcggcctgagcaatcaatgatgaaccgattttgtctccaagagcagccatagatatagctggaggccctagaaattcaatcccctttgcggttagtgcatctggaagctcagggat

SEQ ID NO: 2989 - DNA, 200 bp, Kochia scoparia
ttcacaaactttctttttctcaaggagtttcctaatcagttttcttaaatttctatgctttaggtgaaagttcctgctgagagttgccttgatactattcctgatgatatatacaaggcagcctgtgtttttaccacagaggaagcagttgctagttgtcaggttgtcggttatccagctatgattaaagcatcttgggg

SEQ ID NO: 2990 - DNA, 200 bp, Kochia scoparia
ccccaagatgctttaatcatagctggataaccgacaacctgacaactagcaactgcttcctctgtggtaaaaacacaggctgccttgtatatatcatcaggaatagtatcaaggcaactctcagcaggaactttcacctaaagcatagaaatttaagaaaactgattaggaaactccttgagaaaaagaaagtttgtgaa

SEQ ID NO: 2991 - DNA, 200 bp, Kochia scoparia
cagctatgattaaagcatcttggggtggtggagggaaaggaataagaaaggtgagctagttgtttgggatgatgtcgtcaagaaattaaagcaccggcttcattgcttatttatcacccttttcacagcttccatccttggacatccttttaattaactgtccagtaatatttactagacttaaatgatggacaaatgct

SEQ ID NO: 2992 - DNA, 200 bp, Kochia scoparia
agcatttgtccatcatttaagtctagtaaatattactggacagttaattaaaaggatgtccaaggatggaagctgtgaaaagggtgataaataagcaatgaagccggtgctttaatttcttgacgacatcatcccaaacaactagctcacctttcttattcctttccctccaccaccccaagatgctttaatcatagctg

SEQ ID NO: 2993 - DNA, 200 bp, Kochia scoparia
tagacttaaatgatggacaaatgcttcaaacttgttagttagagacccgttgtgctatttcaattacaattgtctttctctcaaaatatcacaaagactcaatagttatgcattttcaggtgcataatgatgatgaagtaagggcattgttcaagcaagtgcagggcgaagttcctggctctcccatatttataatgaag

SEQ ID NO: 2994 - DNA, 200 bp, Kochia scoparia
cttcattataaatatgggagagccaggaacttcgccctgcacttgcttgaacaatgcccttacttcatcatcattatgcacctgaaaatgcataactattgagtctttgtgatattttgagagaaagacaattgtaattgaaatagcacaacgggtctctaactaacaagtttgaagcatttgtccatcatttaagtcta

SEQ ID NO: 2995 - DNA, 200 bp, Kochia scoparia
tggctctcccatatttataatgaaggtggcttcacaggttagttattctgcaaattggtgctagaatgtatcatttaagtactcacaagtccatggcactcatgattttagaactagtactgtacgcaaaattctttgattttgacaagttattatatgtgcttcagagtcgacacttagaagtgcagttaatttgtgat

SEQ ID NO: 2996 - DNA, 200 bp, Kochia scoparia
atcacaaattaactgcacttctaagtgtcgactctgaagcacatataataacttgtcaaaatcaaagaattttgcgtacagtactagttctaaaatcatgagtgccatggacttgtgagtacttaaatgatacattctagcaccaatttgcagaataactaacctgtgaagccaccttcattataaatatgggagagcca

SEQ ID NO: 2997 - DNA, 200 bp, Kochia scoparia
cttagaagtgcagttaatttgtgatcaatatggcaatgtagcagctttgcatagccgtgattgcagtgtccaaaggcggcaccagaaggtgggtcactagtgtactatcaataaatttttaatcttcttgaccagttttgtattacttagggtctaaagttgtttttttcatagagaatcgtgatgctcattgttcattg

SEQ ID NO: 2998 - DNA, 200 bp, Kochia scoparia
caatgaacaatgagcatcacgattctctatgaaaaaaacaactttagaccctaagtaatacaaaactggtcaagaagattaaaaatttattgatagtacactagtgacccaccttctggtgccgcctttggacactgcaatcacggctatgcaaagctgctacattgccatattgatcacaaattaactgcacttctaag

SEQ ID NO: 2999 - DNA, 200 bp, Kochia scoparia
gaatcgtgatgctcattgttcattgaaggaatgtataaatgatcttgttcattgtattaattgatcagattattgaagagggtccaataaatgtagctccccaagaaactgtgataaaacttgagcaggcagccagaaggttagccaaatatgtgaattttgttggagcagcaactgtagaatatctatacagcatggaa

SEQ ID NO: 3000 - DNA, 200 bp, Kochia scoparia
ttccatgctgtatagatattctacagttgctgctccaacaaaattcacatatttggctaaccttctggctgcctgctcaagttttatcacagtttcttggggagctacatttattggaccctcttcaataatctgatcaattaatacaatgaacaagatcatttatacattccttcaatgaacaatgagcatcacgattc

SEQ ID NO: 3001 - DNA, 200 bp, Kochia scoparia
tgtagaatatctatacagcatggaaactggcgagttttatttcctcgagctaaaccctcggctacaggtatgaagcatacacttgcacattgtatattcatatttacctcgaataattactcaagaaagaaaatgttttatgtcaatatttatggcattgcatctcaatatcctttggatttatcgttttctaccttacg

SEQ ID NO: 3002 - DNA, 200 bp, Kochia scoparia
cgtaaggtagaaaacgataaatccaaaggatattgagatgcaatgccataaatattgacataaaacattttctttcttgagtaattattcgaggtaaatatgaatatacaatgtgcaagtgtatgcttcatacctgtagccgagggtttagctcgaggaaataaaactcgccagtttccatgctgtatagatattctaca

SEQ ID NO: 3003 - DNA, 200 bp, Kochia scoparia
tggatttatcgttttctaccttacgtttgtggctcactttaatatgacttgcttttgttaaggagccttgggatttcttagagtgagatatgacactcttgcctttcaacttttgtgaaccatgtctgatactccctccatttccttttgtttgtttgatttatatcttgaggggtgatattattcataggtagagagat

SEQ ID NO: 3004 - DNA, 200 bp, Kochia scoparia
atctctctacctatgaataatatcacccctcaagatataaatcaaacaaacaaaaggaaatggagggagtatcagacatggttcacaaaagttgaaaggcaagagtgtcatatctcactctaagaaatcccaaggctccttaacaaaagcaagtcatattaaagtgagccacaaacgtaaggtagaaaacgataaatcca

SEQ ID NO: 3005 - DNA, 200 bp, Kochia scoparia
tgatattattcataggtagagagattcctctaaatttataagatgagacatagctctgaggggtcttgttgaattcatcttgatgagtactttaaatcaaagccttgatgagtacttcaataatattaaatttttagaatttttattcttatatagttaaagatactaacaactaaaaatttgctccaacaaatgtgtga

SEQ ID NO: 3006 - DNA, 200 bp, Kochia scoparia
tcacacatttgttggagcaaatttttagttgttagtatctttaactatataagaataaaaattctaaaaatttaatattattgaagtactcatcaaggctttgatttaaagtactcatcaagatgaattcaacaagacccctcagagctatgtctcatcttataaatttagaggaatctctctacctatgaataatatca

SEQ ID NO: 3007 - DNA, 200 bp, Kochia scoparia
aaaatttgctccaacaaatgtgtgataatgaatcgggacaaaagaagggaatggagggagtattactaagaattagcaatcctatatgatcatgtgatggatgaaaaaaaaaattcttatttgacttttctgacaatattgtatataatgtctgacatatgtgtaggttttattatatttaattttaaaaaattcctgtt

SEQ ID NO: 3008 - DNA, 200 bp, Kochia scoparia
aacaggaattttttaaaattaaatataataaaacctacacatatgtcagacattatatacaatattgtcagaaaagtcaaataagaattttttttttcatccatcacatgatcatataggattgctaattcttagtaatactccctccattcccttcttttgtcccgattcattatcacacatttgttggagcaaatttt

SEQ ID NO: 3009 - DNA, 200 bp, Kochia scoparia
tatttaattttaaaaaattcctgtttggaaaatccggttaattttattggttatttatctaattccttcttttgttcgcgtttgataaatacaggtggagcacccagtaactgaatggattgctggaattaaccttccagctgctcaggttgcagttggcatgggtattcccctctggcaaattccaggtagctagcatg

SEQ ID NO: 3010 - DNA, 200 bp, Kochia scoparia
catgctagctacctggaatttgccagaggggaatacccatgccaactgcaacctgagcagctggaaggttaattccagcaatccattcagttactgggtgctccacctgtatttatcaaacgcgaacaaaagaaggaattagataaataaccaataaaattaaccggattttccaaacaggaattttttaaaattaaata

SEQ ID NO: 3011 - DNA, 200 bp, Kochia scoparia
tggcaaattccaggtagctagcatgttccctttttttattatataacttatgtgcttcatcttgttcttgtgtatgagttggcttgcttttgcaatttcaaaatagaaattcggcgattctatggtaaggaacatggtggcggttatgatgcttggagaagaacatcagttgcagcgactccttttgattttgacaaggc

SEQ ID NO: 3012 - DNA, 200 bp, Kochia scoparia
gccttgtcaaaatcaaaaggagtcgctgcaactgatgttcttctccaagcatcataaccgccaccatgttccttaccatagaatcgccgaatttctattttgaaattgcaaaagcaagccaactcatacacaagaacaagatgaagcacataagttatataataaaaaaagggaacatgctagctacctggaatttgcca

SEQ ID NO: 3013 - DNA, 200 bp, Kochia scoparia
cgactccttttgattttgacaaggcacaatctgtgaaaccaaaaggtcactgtactgccgtacgtgtgacaagtgaggaccctgatgatggattcaagcccactagtgggaaagtacaggttaataatgctattgttttatagttcaaactattttctcaattgattgccttgtctgttttgtgattcatgtaaaattat

SEQ ID NO: 3014 - DNA, 200 bp, Kochia scoparia
ataattttacatgaatcacaaaacagacaaggcaatcaattgagaaaatagtttgaactataaaacaatagcattattaacctgtactttcccactagtgggcttgaatccatcatcagggtcctcacttgtcacacgtacggcagtacagtgaccttttggtttcacagattgtgccttgtcaaaatcaaaaggagtcg

SEQ ID NO: 3015 - DNA, 200 bp, Kochia scoparia
tgttttgtgattcatgtaaaattatttaattcattggtttcttttctaggagttgagtttcaaaagtaaaccaaatgtgtgggcctatttctctgttaaggtatgtctttattttttttaagctttacatcatccttttatggattcatccacgagcttaacaatggtcaacactgtcaattgcagtctgggggaggcat

SEQ ID NO: 3016 - DNA, 200 bp, Kochia scoparia
atgcctcccccagactgcaattgacagtgttgaccattgttaagctcgtggatgaatccataaaaggatgatgtaaagcttaaaaaaaataaagacataccttaacagagaaataggcccacacatttggtttacttttgaaactcaactcctagaaaagaaaccaatgaattaaataattttacatgaatcacaaaaca

SEQ ID NO: 3017 - DNA, 200 bp, Kochia scoparia
gtcaattgcagtctgggggaggcattcatgaattctcagattctcaatttggtaagtttaaagcacattttaaagatgactagcaatgaaatgactattatagctgccttttaagaatgaagttcttcaacatcatagtattcattctctaatttaagactgctgcaaatggattgagaactgtgctgttgtgcatgtga

SEQ ID NO: 3018 - DNA, 200 bp, Kochia scoparia
tcacatgcacaacagcacagttctcaatccatttgcagcagtcttaaattagagaatgaatactatgatgttgaagaacttcattcttaaaaggcagctataatagtcatttcattgctagtcatctttaaaatgtgctttaaacttaccaaattgagaatctgagaattcatgaatgcctcccccagactgcaattgac

SEQ ID NO: 3019 - DNA, 200 bp, Kochia scoparia
gagaactgtgctgttgtgcatgtgaaatgagatatattggtttttcatagtgtgtcattgtagacagtaaatgctcttgttaattgttgatgattggaattgggatttagcatgcttggtgtagttttctcttgcacaaacaagtctcatggaattaacatgtcattttttttatcgattatttttggttttaaaacatc

SEQ ID NO: 3020 - DNA, 200 bp, Kochia scoparia
gatgttttaaaaccaaaaataatcgataaaaaaaatgacatgttaattccatgagacttgtttgtgcaagagaaaactacaccaagcatgctaaatcccaattccaatcatcaacaattaacaagagcatttactgtctacaatgacacactatgaaaaaccaatatatctcatttcacatgcacaacagcacagttctc

SEQ ID NO: 3021 - DNA, 200 bp, Kochia scoparia
cgattatttttggttttaaaacatcctttatctattttttttattttttttatagaaggctaatgttagttaatttgtttgtagggcatgtctttgcatttggtgaatcaagagggttggccatagcaaacatggttcatggcttaaaagaaattcaaattcatggagaaattcgcacgaatgttgattataccattgat

SEQ ID NO: 3022 - DNA, 200 bp, Kochia scoparia
atcaatggtataatcaacattcgtgcgaatttctccatgaatttgaatttcttttaagccatgaaccatgtttgctatggccaaccctcttgattcaccaaatgcaaagacatgccctacaaacaaattaactaacattagccttctataaaaaaaataaaaaaaatagataaaggatgttttaaaaccaaaaataatcg

SEQ ID NO: 3023 - DNA, 200 bp, Kochia scoparia
cacgaatgttgattataccattgatcttttaaacgtgagccttgtacatgattttttttcctccctacactttccactgttttttcaattagaagctaaagttgtctttgtttttcctttctccagtcttcggattacagagataataaaattcatacaggttggttagatagcagaattgcaatgagagtgagagcgga

SEQ ID NO: 3024 - DNA, 200 bp, Kochia scoparia
tccgctctcactctcattgcaattctgctatctaaccaacctgtatgaattttattatctctgtaatccgaagactggagaaaggaaaaacaaagacaactttagcttctaattgaaaaaacagtggaaagtgtagggaggaaaaaaaatcatgtacaaggctcacgtttaaaagatcaatggtataatcaacattcgtg

SEQ ID NO: 3025 - DNA, 200 bp, Kochia scoparia
gaattgcaatgagagtgagagcggaaagacccccctggttcatctctgttgtgggaggagcactctacgtatgtacagctttttttctctaaaatttgtttccttccaaaagcttcatgtgtcactttcgtttatttttataatgaataattttaaatacttcgtaatttctttctcctttctccctatcttcagaaagc

SEQ ID NO: 3026 - DNA, 200 bp, Kochia scoparia
gctttctgaagatagggagaaaggagaaagaaattacgaagtatttaaaattattcattataaaaataaacgaaagtgacacatgaagcttttggaaggaaacaaattttagagaaaaaaagctgtacatacgtagagtgctcctcccacaacagagatgaaccaggggggtctttccgctctcactctcattgcaattc

SEQ ID NO: 3027 - DNA, 200 bp, Kochia scoparia
tcctttctccctatcttcagaaagcttttgctagtagtacagctacagtttcagaatatgttggctatcttgagaaaggtcaaattcctccaaaggtaattcatgcaccagacgctgttgaggtatactggtttttttaaacactaattgtttctttcagtaaattacatcaatatttgtgtggattgcagcatatatca

SEQ ID NO: 3028 - DNA, 200 bp, Kochia scoparia
tgatatatgctgcaatccacacaaatattgatgtaatttactgaaagaaacaattagtgtttaaaaaaaccagtatacctcaacagcgtctggtgcatgaattacctttggaggaatttgacctttctcaagatagccaacatattctgaaactgtagctgtactactagcaaaagctttctgaagatagggagaaagga

SEQ ID NO: 3029 - DNA, 200 bp, Kochia scoparia
tttgtgtggattgcagcatatatcacttgtccactctgaagtttctctgaatattgaggggagcaagtacactgtaagtatattattataactgatgtgaattttatatttcattttcgatttcttctgttttcttgttaatcatcataacatggttgatgctgttctctagatcaaagtggtgaggggcggtccaggaa

SEQ ID NO: 3030 - DNA, 200 bp, Kochia scoparia
ttcctggaccgcccctcaccactttgatctagagaacagcatcaaccatgttatgatgattaacaagaaaacagaagaaatcgaaaatgaaatataaaattcacatcagttataataatatacttacagtgtacttgctcccctcaatattcagagaaacttcagagtggacaagtgatatatgctgcaatccacacaaa

SEQ ID NO: 3031 - DNA, 200 bp, Kochia scoparia
aaagtggtgaggggcggtccaggaaactacagattgagattgaatgagtctgagattgaggctgaaatacatccattaagagatgggggtcttttgatgcaagtaagaacttaacttttattcattcatatattcatgattgagggcaattgtcaaattatacacatataggagtgataatatgtgtagagttaaaattg

SEQ ID NO: 3032 - DNA, 200 bp, Kochia scoparia
caattttaactctacacatattatcactcctatatgtgtataatttgacaattgccctcaatcatgaatatatgaatgaataaaagttaagttcttacttgcatcaaaagacccccatctcttaatggatgtatttcagcctcaatctcagactcattcaatctcaatctgtagtttcctggaccgcccctcaccacttt

SEQ ID NO: 3033 - DNA, 200 bp, Kochia scoparia
gataatatgtgtagagttaaaattgcgagtgaaagctgagatattactctatgtatttagtatatcattcaccatagaatgcttgagttacttgcgttaaattaaaaaaaaaggaaagagtagaaattagagagtctaatttctgtggtcacaatgatatgtctaattgaacgcacccaatgtgtttcagttattttttt

SEQ ID NO: 3034 - DNA, 200 bp, Kochia scoparia
aaaaaaataactgaaacacattgggtgcgttcaattagacatatcattgtgaccacagaaattagactctctaatttctactctttcctttttttttaatttaacgcaagtaactcaagcattctatggtgaatgatatactaaatacatagagtaatatctcagctttcactcgcaattttaactctacacatattatc

SEQ ID NO: 3035 - DNA, 200 bp, Kochia scoparia
cccaatgtgtttcagttatttttttacccctaacataggagggaaaactgacttagcggcttcccctctagcataggatataagtgctccaaactcttagaatatctaaatttgaaaaacttataatgtattattgacattctttcagagaatgcttttctgtgtgaactccttaagtatgttaatagcaatcccgcaac

SEQ ID NO: 3036 - DNA, 200 bp, Kochia scoparia
gttgcgggattgctattaacatacttaaggagttcacacagaaaagcattctctgaaagaatgtcaataatacattataagtttttcaaatttagatattctaagagtttggagcacttatatcctatgctagaggggaagccgctaagtcagttttccctcctatgttaggggtaaaaaaataactgaaacacattggg

SEQ ID NO: 3037 - DNA, 200 bp, Kochia scoparia
agtatgttaatagcaatcccgcaaccctgtttcacattatataggtatttgtttcttattagatgatattccatatctccatataagatctttcttcttaccaattcaagccatatattttttggattaagaagatgatattcacaaaaggtttgcgttatgatgatactcaatatacccacatgtttcatattttcatt

SEQ ID NO: 3038 - DNA, 200 bp, Kochia scoparia
aatgaaaatatgaaacatgtgggtatattgagtatcatcataacgcaaaccttttgtgaatatcatcttcttaatccaaaaaatatatggcttgaattggtaagaagaaagatcttatatggagatatggaatatcatctaataagaaacaaatacctatataatgtgaaacagggttgcgggattgctattaacatact

SEQ ID NO: 3039 - DNA, 200 bp, Kochia scoparia
tacccacatgtttcatattttcattgacttaaacgctatttcttagaaaagttggagttgttgatccaatgtatgtgctaggttctcatccctttgttttcaattagctatggattttgagctcttctgtacatttgaatgtgatgtagttggatgggaaaagtcacgtgatatatgctcaggaagaggcagcaggaact

SEQ ID NO: 3040 - DNA, 200 bp, Kochia scoparia
agttcctgctgcctcttcctgagcatatatcacgtgacttttcccatccaactacatcacattcaaatgtacagaagagctcaaaatccatagctaattgaaaacaaagggatgagaacctagcacatacattggatcaacaactccaacttttctaagaaatagcgtttaagtcaatgaaaatatgaaacatgtgggta

SEQ ID NO: 3041 - DNA, 200 bp, Kochia scoparia
tgctcaggaagaggcagcaggaactcgccttcttattgatggacgaacgtgtttgcttcaggtaccatcatgttatttaattgcatagtatttctaaacatttaccaagcgtaacatgctattacattttccacttcttcaatattcagaatgatcatgatccttcaaagttaattgcggaaacaccttgtaagctactg

SEQ ID NO: 3042 - DNA, 200 bp, Kochia scoparia
cagtagcttacaaggtgtttccgcaattaactttgaaggatcatgatcattctgaatattgaagaagtggaaaatgtaatagcatgttacgcttggtaaatgtttagaaatactatgcaattaaataacatgatggtacctgaagcaaacacgttcgtccatcaataagaaggcgagttcctgctgcctcttcctgagca

SEQ ID NO: 3043 - DNA, 200 bp, Kochia scoparia
tgcggaaacaccttgtaagctactgcggtatttggttccagatgatagtcatgttgatccagatactccatttgctgaagttgaggttatgaagatgtgtatgcctttgctttcccctgcatctggtaaaataagatttaagatgtccgaaggacaacccatgcaggttagcataggttttggtagatctatatgttaac

SEQ ID NO: 3044 - DNA, 200 bp, Kochia scoparia
gttaacatatagatctaccaaaacctatgctaacctgcatgggttgtccttcggacatcttaaatcttattttaccagatgcaggggaaagcaaaggcatacacatcttcataacctcaacttcagcaaatggagtatctggatcaacatgactatcatctggaaccaaataccgcagtagcttacaaggtgtttccgca

SEQ ID NO: 3045 - DNA, 200 bp, Kochia scoparia
ggttttggtagatctatatgttaactaattatacttcaaaagtttcttctaagtgaaggttcactgtgtaggctggcgagctcatagcaaaacttgagttggatgatccttcagctgtaagaaaagctgaaccgttccgtggtagttttccaaccttgcatccgccaactgctatctcagaaaaggttcatcaaaaattt

SEQ ID NO: 3046 - DNA, 200 bp, Kochia scoparia
aaatttttgatgaaccttttctgagatagcagttggcggatgcaaggttggaaaactaccacggaacggttcagcttttcttacagctgaaggatcatccaactcaagttttgctatgagctcgccagcctacacagtgaaccttcacttagaagaaacttttgaagtataattagttaacatatagatctaccaaaacc

SEQ ID NO: 3047 - DNA, 200 bp, Kochia scoparia
ctcagaaaaggttcatcaaaaatttgttgcaagtttgaatgcagcccagatgattcttgctggttttgaacacaacatagatgaagtaagtattttaatagtgaattcaaaaatattgagcactatattatatagatgaagtatttcagttatgaattaaacatagatgatgtaagtattactctaagggggctgatgca

SEQ ID NO: 3048 - DNA, 200 bp, Kochia scoparia
tgcatcagcccccttagagtaatacttacatcatctatgtttaattcataactgaaatacttcatctatataatatagtgctcaatatttttgaattcactattaaaatacttacttcatctatgttgtgttcaaaaccagcaagaatcatctgggctgcattcaaacttgcaacaaatttttgatgaaccttttctgag

SEQ ID NO: 3049 - DNA, 200 bp, Kochia scoparia
gtattactctaagggggctgatgcaaaaatttgagagtaaatgtatatttatattttgtttggttcccttatctgaaagattctttacaaaagagttttctaattctcaggttgtccagagtttgttgaggtgccttgatagtcctgaacttcctttcttgcaatggcaagaatgcttgtctgttctagcaacacggctt

SEQ ID NO: 3050 - DNA, 200 bp, Kochia scoparia
aagccgtgttgctagaacagacaagcattcttgccattgcaagaaaggaagttcaggactatcaaggcacctcaacaaactctggacaacctgagaattagaaaactcttttgtaaagaatctttcagataagggaaccaaacaaaatataaatatacatttactctcaaatttttgcatcagcccccttagagtaatac

SEQ ID NO: 3051 - DNA, 200 bp, Kochia scoparia
cttgtctgttctagcaacacggcttcccaaagatctgagaactgaagtatgttactaaaatctgtatgcaatttttttccatatttgataaacacctgctgtctttagcagtctttatcttctttggtctttctccctctctctctctctctctcaccctgtgtataattcacattatttttccatgtttccctgtcttt

SEQ ID NO: 3052 - DNA, 200 bp, Kochia scoparia
aaagacagggaaacatggaaaaataatgtgaattatacacagggtgagagagagagagagagagggagaaagaccaaagaagataaagactgctaaagacagcaggtgtttatcaaatatggaaaaaaattgcatacagattttagtaacatacttcagttctcagatctttgggaagccgtgttgctagaacagacaag

SEQ ID NO: 3053 - DNA, 200 bp, Kochia scoparia
tatttttccatgtttccctgtctttggtattctcagttggaatcaaagtgtcgaaaattcacaggaattacgaattctcataacattgaatttcctgctaagctgtttaaaggtgttcttgaggttagtctttctttttgttacccttctatatatgctatatattttagtattacttacataagtattttgtttacagg

SEQ ID NO: 3054 - DNA, 200 bp, Kochia scoparia
cctgtaaacaaaatacttatgtaagtaatactaaaatatatagcatatatagaagggtaacaaaaagaaagactaacctcaagaacacctttaaacagcttagcaggaaattcaatgttatgagaattcgtaattcctgtgaattttcgacactttgattccaactgagaataccaaagacagggaaacatggaaaaata

SEQ ID NO: 3055 - DNA, 200 bp, Kochia scoparia
cttacataagtattttgtttacaggcccatttgaattcatgccctgaaaaggagagaggagctcaagagcggctcattgaacctctaatgagtcttgttaaatcctatgaaggtgggagagagagtcatgcccatgttattgttcagtctctgtttgaagagtatttgactgttgaagaattgttcagtgacaatatcca

SEQ ID NO: 3056 - DNA, 200 bp, Kochia scoparia
tggatattgtcactgaacaattcttcaacagtcaaatactcttcaaacagagactgaacaataacatgggcatgactctctctcccaccttcataggatttaacaagactcattagaggttcaatgagccgctcttgagctcctctctccttttcagggcatgaattcaaatgggcctgtaaacaaaatacttatgtaag

SEQ ID NO: 3057 - DNA, 200 bp, Kochia scoparia
aagaattgttcagtgacaatatccaggtttgttattgcagttgcaaattgatcagtttttttggtcaaccaatttgtaccgggacaaattgccacagtcctaatttattgatgatcatcggtcttcgtgtttttttcccggtttggttgattggttatcatgttatgaagttgtcacataaaaaaacctaaatttactaa

SEQ ID NO: 3058 - DNA, 200 bp, Kochia scoparia
ttagtaaatttaggtttttttatgtgacaacttcataacatgataaccaatcaaccaaaccgggaaaaaaacacgaagaccgatgatcatcaataaattaggactgtggcaatttgtcccggtacaaattggttgaccaaaaaaactgatcaatttgcaactgcaataacaaacctggatattgtcactgaacaattctt

SEQ ID NO: 3059 - DNA, 200 bp, Kochia scoparia
acataaaaaaacctaaatttactaatgcacccatttgaccctagaggctacagagtctttggagtactctgtctctgtggatttatagtagcatcctttgaagtattactttattttttcaagaaattgtagttcatgtcttttgattctgatcttgaaaggaaggctgacatcattccactttattttctaatttcaat

SEQ ID NO: 3060 - DNA, 200 bp, Kochia scoparia
attgaaattagaaaataaagtggaatgatgtcagccttcctttcaagatcagaatcaaaagacatgaactacaatttcttgaaaaaataaagtaatacttcaaaggatgctactataaatccacagagacagagtactccaaagactctgtagcctctagggtcaaatgggtgcattagtaaatttaggtttttttatgt

SEQ ID NO: 3061 - DNA, 200 bp, Kochia scoparia
ttccactttattttctaatttcaatctatacaggctgatgtgattgaacgtctccgccttcaacataaaaaagacctgttaaaggttgttgacattgtcctatcacatcaggtaggcaggaaatttcaaataatacaaaataaaattttctgagttttctttttattttcttttcttttttttcccactttcccttgtac

SEQ ID NO: 3062 - DNA, 200 bp, Kochia scoparia
gtacaagggaaagtgggaaaaaaaagaaaagaaaataaaaagaaaactcagaaaattttattttgtattatttgaaatttcctgcctacctgatgtgataggacaatgtcaacaacctttaacaggtcttttttatgttgaaggcggagacgttcaatcacatcagcctgtatagattgaaattagaaaataaagtggaa

SEQ ID NO: 3063 - DNA, 200 bp, Kochia scoparia
ttttttttcccactttcccttgtactgtcttctagacttgtttactgtgtagtaataatggttttcagggtgttaagaataaaaataaattgatcctccggctcatggaacaactggtttactcaaatcctgccgcatatcgggataagcttaaacatttttcacaactaaaccatacaatctactctgaggttagtgat

SEQ ID NO: 3064 - DNA, 200 bp, Kochia scoparia
atcactaacctcagagtagattgtatggtttagttgtgaaaaatgtttaagcttatcccgatatgcggcaggatttgagtaaaccagttgttccatgagccggaggatcaatttatttttattcttaacaccctgaaaaccattattactacacagtaaacaagtctagaagacagtacaagggaaagtgggaaaaaaaa

SEQ ID NO: 3065 - DNA, 200 bp, Kochia scoparia
tacaatctactctgaggttagtgattattcaattttttgtttatattgtcacactacagcattcacaaaaaggttattaagtttatacactaatcaattccttcactatatgcagttggcacttaaggcaagtcaattgcttgaacaaaccaagttgagtgaacttcgttctaatattgccagaaacctttccgagttag

SEQ ID NO: 3066 - DNA, 200 bp, Kochia scoparia
ctaactcggaaaggtttctggcaatattagaacgaagttcactcaacttggtttgttcaagcaattgacttgccttaagtgccaactgcatatagtgaaggaattgattagtgtataaacttaataacctttttgtgaatgctgtagtgtgacaatataaacaaaaaattgaataatcactaacctcagagtagattgta

SEQ ID NO: 3067 - DNA, 200 bp, Kochia scoparia
attgccagaaacctttccgagttagaaatgtttacagaagatggtgaaaacatggacactccaaaaaggaaaagtgctattaatgagcgtatggaggctcttgtgaatactccgcttgctgttgaagatgcccttgttggcttgttcgatcacagcgatcatacgttacaaaggcgggttgttgagacttatgtccggag

SEQ ID NO: 3068 - DNA, 200 bp, Kochia scoparia
ctccggacataagtctcaacaacccgcctttgtaacgtatgatcgctgtgatcgaacaagccaacaagggcatcttcaacagcaagcggagtattcacaagagcctccatacgctcattaatagcacttttcctttttggagtgtccatgttttcaccatcttctgtaaacatttctaactcggaaaggtttctggcaat

SEQ ID NO: 3069 - DNA, 200 bp, Kochia scoparia
gggttgttgagacttatgtccggagactttatcaagtaatatctaagttccaacagtaaactttaactatcatttaataatgttatgtcatataactctattttttgtgggtaatctcttttctcagccttatcttgtaaaaggaagtgtcaggatgcagtggcacagatctggcctcattgtttcttgggagttcatgg

SEQ ID NO: 3070 - DNA, 200 bp, Kochia scoparia
ccatgaactcccaagaaacaatgaggccagatctgtgccactgcatcctgacacttccttttacaagataaggctgagaaaagagattacccacaaaaaatagagttatatgacataacattattaaatgatagttaaagtttactgttggaacttagatattacttgataaagtctccggacataagtctcaacaaccc

SEQ ID NO: 3071 - DNA, 200 bp, Kochia scoparia
ctcattgtttcttgggagttcatggaggagcacattgaaagagcaaatgcctctaatgatctgtccatcaaccagccccttgttgagaaacacagtgagagaaaatggggagccatggtcatcataaaatctcttcagtttttgccaacagtgattactgctgcattaaaagagacaacacataattcagatgaaacgat

SEQ ID NO: 3072 - DNA, 200 bp, Kochia scoparia
atcgtttcatctgaattatgtgttgtctcttttaatgcagcagtaatcactgttggcaaaaactgaagagattttatgatgaccatggctccccattttctctcactgtgtttctcaacaaggggctggttgatggacagatcattagaggcatttgctctttcaatgtgctcctccatgaactcccaagaaacaatgag

SEQ ID NO: 3073 - DNA, 200 bp, Kochia scoparia
caacacataattcagatgaaacgattcccagaggctctttagaatcaatcagtcatggaaatatgttgcacattgcacttgtgggtgttaataaccagatgagcttgttgcaggataggtatagattctatttttatggtttaagcaagattttaaaatgtgaacattggactatccaattttatttatgtttatttatt

SEQ ID NO: 3074 - DNA, 200 bp, Kochia scoparia
aataaataaacataaataaaattggatagtccaatgttcacattttaaaatcttgcttaaaccataaaaatagaatctatacctatcctgcaacaagctcatctggttattaacacccacaagtgcaatgtgcaacatatttccatgactgattgattctaaagagcctctgggaatcgtttcatctgaattatgtgttg

SEQ ID NO: 3075 - DNA, 200 bp, Kochia scoparia
ccaattttatttatgtttatttatttatttatttttttgacgaggactatccagtttttttgaagaaatatgctttgcttcaattatgcagtcgctctttatagtaaccattccggccttttgcttaacctttttttctctgtggggtttatgaaatggaattttatactatgcagtggtgatgaagatcaagctcaaga

SEQ ID NO: 3076 - DNA, 200 bp, Kochia scoparia
tcttgagcttgatcttcatcaccactgcatagtataaaattccatttcataaaccccacagagaaaaaaaggttaagcaaaaggccggaatggttactataaagagcgactgcataattgaagcaaagcatatttcttcaaaaaaactggatagtcctcgtcaaaaaaataaataaataaataaacataaataaaattgg

SEQ ID NO: 3077 - DNA, 200 bp, Kochia scoparia
gtggtgatgaagatcaagctcaagagagaattgataagttggcaaaaatcctgagagagaaagaagtgagctcaggtcttcgtgacgttggtgtcagggtaattagttgcattatacagagagatgaaggaagaacgccaatgaggcattcattctattggtcagaagagaaacaatacttcaatgaagagcctttacta

SEQ ID NO: 3078 - DNA, 200 bp, Kochia scoparia
tagtaaaggctcttcattgaagtattgtttctcttctgaccaatagaatgaatgcctcattggcgttcttccttcatctctctgtataatgcaactaattaccctgacaccaacgtcacgaagacctgagctcacttctttctctctcaggatttttgccaacttatcaattctctcttgagcttgatcttcatcaccac

SEQ ID NO: 3079 - DNA, 200 bp, Kochia scoparia
atacttcaatgaagagcctttactacgtcatttggaacctcctctatcaatatatcttgaactggtaataaaattctgagcaagaagctgttgctttgtttgttcgttcttttcttgttttttaatatgggccaaatcattatctttaatatttttatcactatatgatatagttataaggtatttggctcacaattttc

SEQ ID NO: 3080 - DNA, 200 bp, Kochia scoparia
gaaaattgtgagccaaataccttataactatatcatatagtgataaaaatattaaagataatgatttggcccatattaaaaaacaagaaaagaacgaacaaacaaagcaacagcttcttgctcagaattttattaccagttcaagatatattgatagaggaggttccaaatgacgtagtaaaggctcttcattgaagtat

SEQ ID NO: 3081 - DNA, 200 bp, Kochia scoparia
ataaggtatttggctcacaattttcattatacaggacaagctcaaacactatgaaaatcccagatatactccttctcgggatcatcagtggcacctgtatactgtcatggacaagccatctattcgacgaatgtttttgaggacacttgtcagacagcccacctccgagtttagcggggttgaactagaaatgcttaaaa

SEQ ID NO: 3082 - DNA, 200 bp, Kochia scoparia
ttttaagcatttctagttcaaccccgctaaactcggaggtgggctgtctgacaagtgtcctcaaaaacattcgtcgaatagatggcttgtccatgacagtatacaggtgccactgatgatcccgagaaggagtatatctgggattttcatagtgtttgagcttgtcctgtataatgaaaattgtgagccaaataccttat

SEQ ID NO: 3083 - DNA, 200 bp, Kochia scoparia
ggggttgaactagaaatgcttaaaacacaaaggcctatctcctttacttcaagaaacatactgaggtctttaacaactgcaatggaagaattagaactcaatgcgcacaatgctaccttgaaacctgatcatgctcatatgtacctgtgcattgtaagagagcaacgaattcaagatcttgtcccatatcacaggttcta

SEQ ID NO: 3084 - DNA, 200 bp, Kochia scoparia
tagaacctgtgatatgggacaagatcttgaattcgttgctctcttacaatgcacaggtacatatgagcatgatcaggtttcaaggtagcattgtgcgcattgagttctaattcttccattgcagttgttaaagacctcagtatgtttcttgaagtaaaggagataggcctttgtgttttaagcatttctagttcaacccc

SEQ ID NO: 3085 - DNA, 200 bp, Kochia scoparia
atcttgtcccatatcacaggttctaattaatcatcttaattttctgtgtttcattcgtggtcattgatgcaacttatgccttaatagatattattttgacccattgatccagggaggtgaacattgatgatgaacaagaagagataactgttcagatatatttggaagagcttgcgcgtgaaatccacagttttgctggt

SEQ ID NO: 3086 - DNA, 200 bp, Kochia scoparia
accagcaaaactgtggatttcacgcgcaagctcttccaaatatatctgaacagttatctcttcttgttcatcatcaatgttcacctccctggatcaatgggtcaaaataatatctattaaggcataagttgcatcaatgaccacgaatgaaacacagaaaattaagatgattaattagaacctgtgatatgggacaagat

SEQ ID NO: 3087 - DNA, 200 bp, Kochia scoparia
gcgtgaaatccacagttttgctggtgtgagaatgcataaactaaatgtatgtgagtgggaagtaaagctttgggtgtcatcttctggccaagccaatggttcatggagaatcattgttaataatgtgactggtcatacatgcactgtacatgtaagtttgaactatgataattttttcctataattttctgtaaaggttt

SEQ ID NO: 3088 - DNA, 200 bp, Kochia scoparia
aaacctttacagaaaattataggaaaaaattatcatagttcaaacttacatgtacagtgcatgtatgaccagtcacattattaacaatgattctccatgaaccattggcttggccagaagatgacacccaaagctttacttcccactcacatacatttagtttatgcattctcacaccagcaaaactgtggatttcacgc

SEQ ID NO: 3089 - DNA, 200 bp, Kochia scoparia
ttcctataattttctgtaaaggtttttagtattggccgtgtttagtaatttctttcaacactcagatatttatgccagtttttgtaagaattatagaaatacagtagcaatgttttgatagcccaggttctctctttctcccaaattaatctttgtgtcaatgcatgactttgccgcatcaatatcttaaataatttatg

SEQ ID NO: 3090 - DNA, 200 bp, Kochia scoparia
cataaattatttaagatattgatgcggcaaagtcatgcattgacacaaagattaatttgggagaaagagagaacctgggctatcaaaacattgctactgtatttctataattcttacaaaaactggcataaatatctgagtgttgaaagaaattactaaacacggccaatactaaaaacctttacagaaaattataggaa

SEQ ID NO: 3091 - DNA, 200 bp, Kochia scoparia
gcatcaatatcttaaataatttatgattataaactataagaatatgatactatgagaaattgaaaatatacatcgagagaaatctaaatacatcttccattacaacctttgatttttttttttttttttaaattgaaaaaacaatgggtaaaggtgatacatgaatcttgtaaaacacaaacaatgaccatacatatggg

SEQ ID NO: 3092 - DNA, 200 bp, Kochia scoparia
cccatatgtatggtcattgtttgtgttttacaagattcatgtatcacctttacccattgttttttcaatttaaaaaaaaaaaaaaaaatcaaaggttgtaatggaagatgtatttagatttctctcgatgtatattttcaatttctcatagtatcatattcttatagtttataatcataaattatttaagatattgatgc

SEQ ID NO: 3093 - DNA, 200 bp, Kochia scoparia
cacaaacaatgaccatacatatgggacggagggagtaataatggtttgtatattggcacttataaagaaaaaggttatgcacaattaatttatgtcttgtagacgtgtatcacataatgtcttctttagtttgctgaccttttttctactaatgttatgcaggtttaccgtgagttggaggataacaaccttcatgaaat

SEQ ID NO: 3094 - DNA, 200 bp, Kochia scoparia
atttcatgaaggttgttatcctccaactcacggtaaacctgcataacattagtagaaaaaaggtcagcaaactaaagaagacattatgtgatacacgtctacaagacataaattaattgtgcataacctttttctttataagtgccaatatacaaaccattattactccctccgtcccatatgtatggtcattgtttgtg

SEQ ID NO: 3095 - DNA, 200 bp, Kochia scoparia
tggaggataacaaccttcatgaaatgatctaccattcaatatctgttcaaggtcctctccatggaataccagtgaatgcaccctatcaaccacttggagtcattgcccgtaaaagacttcaggccaggaaaaatagcacaacctattgttatgacttcccactggtaagaaatattaaactccactataccccaatacta

SEQ ID NO: 3096 - DNA, 200 bp, Kochia scoparia
tagtattggggtatagtggagtttaatatttcttaccagtgggaagtcataacaataggttgtgctatttttcctggcctgaagtcttttacgggcaatgactccaagtggttgatagggtgcattcactggtattccatggagaggaccttgaacagatattgaatggtagatcatttcatgaaggttgttatcctcca

SEQ ID NO: 3097 - DNA, 200 bp, Kochia scoparia
taaactccactataccccaatactacaaaagcagaattttactatattaggtttccttccctcccgaatttttttaaaaaataagagttaatacatgacttgcattcgagtgtaactatggttcttgtttacgctcaactagtaatgaaataggaatataaatctaataaagatttacaaattttggagagaggcggggt

SEQ ID NO: 3098 - DNA, 200 bp, Kochia scoparia
accccgcctctctccaaaatttgtaaatctttattagatttatattcctatttcattactagttgagcgtaaacaagaaccatagttacactcgaatgcaagtcatgtattaactcttattttttaaaaaaattcgggagggaaggaaacctaatatagtaaaattctgcttttgtagtattggggtatagtggagttta

SEQ ID NO: 3099 - DNA, 200 bp, Kochia scoparia
tacaaattttggagagaggcggggttgtgtaactgtgggactttgtaaaggtttaaagttagttaggtggagatgcagggtttatatttagtttatgaggaaactacaagttttcaagattttaataggtaatacgtgtaaaattttaaaagatatcggaatatttgtcttagtattttggattattgtaactttgtaaa

SEQ ID NO: 3100 - DNA, 200 bp, Kochia scoparia
tttacaaagttacaataatccaaaatactaagacaaatattccgatatcttttaaaattttacacgtattacctattaaaatcttgaaaacttgtagtttcctcataaactaaatataaaccctgcatctccacctaactaactttaaacctttacaaagtcccacagttacacaaccccgcctctctccaaaatttgta

SEQ ID NO: 3101 - DNA, 200 bp, Kochia scoparia
acaatgaggcctggtattttataaaaaagaaaagaattgttagtgctaaaaactcctcgtatacaaagttacaaacaacacccagcatccattttgcatatctaacacaaaatatacaaaacatattaggcaggacaaccaagaattcagagggaaatcttaaaatatgttaatgcgggcagtacgattccactgcgaaa

SEQ ID NO: 3102 - DNA, 200 bp, Kochia scoparia
tttcgcagtggaatcgtactgcccgcattaacatattttaagatttccctctgaattcttggttgtcctgcctaatatgttttgtatattttgtgttagatatgcaaaatggatgctgggtgttgtttgtaactttgtatacgaggagtttttagcactaacaattcttttcttttttataaaataccaggcctcattgt

SEQ ID NO: 3103 - DNA, 200 bp, Kochia scoparia
cgggcagtacgattccactgcgaaaaatttactcacttagaccaaggttaggaacaacaatgtacacgaatgttgagcagagaaaatatatacaaatgaagcagttcatatacaataaaaggcagagaagatgcccaatattcccctttcaatcgaaattcacaattgatcttgtcattagaaaagtgaaacaagagggt

SEQ ID NO: 3104 - DNA, 200 bp, Kochia scoparia
accctcttgtttcacttttctaatgacaagatcaattgtgaatttcgattgaaaggggaatattgggcatcttctctgccttttattgtatatgaactgcttcatttgtatatattttctctgctcaacattcgtgtacattgttgttcctaaccttggtctaagtgagtaaatttttcgcagtggaatcgtactgcccg

SEQ ID NO: 3105 - DNA, 200 bp, Kochia scoparia
cattagaaaagtgaaacaagagggtctcatcgtaattaagggaatgaagtatgcttcagccatacccaacagtaccttacaataactgtcaagtttcctcactatcttgagctgcccaagatggtgcagcaagcacttgcgctgctagtctcagaaaaacaactataggcaatcccatcaagatcttgttttcttccagg

SEQ ID NO: 3106 - DNA, 200 bp, Kochia scoparia
cctggaagaaaacaagatcttgatgggattgcctatagttgtttttctgagactagcagcgcaagtgcttgctgcaccatcttgggcagctcaagatagtgaggaaacttgacagttattgtaaggtactgttgggtatggctgaagcatacttcattcccttaattacgatgagaccctcttgtttcacttttctaatg

SEQ ID NO: 3107 - DNA, 200 bp, Kochia scoparia
catcaagatcttgttttcttccaggaattaaaatagttcagtttcatcaacatccaaacatcaaaaacaaaatgacctgagatagaaaagagcacttacaagcaccttttgatgtgcaacaaaagaacaatttcctcagacgaagcactctttctcttacccaaaataggctacacactcattcagatctcagggttgct

SEQ ID NO: 3108 - DNA, 200 bp, Kochia scoparia
agcaaccctgagatctgaatgagtgtgtagcctattttgggtaagagaaagagtgcttcgtctgaggaaattgttcttttgttgcacatcaaaaggtgcttgtaagtgctcttttctatctcaggtcattttgtttttgatgtttggatgttgatgaaactgaactattttaattcctggaagaaaacaagatcttgatg

SEQ ID NO: 3109 - DNA, 200 bp, Kochia scoparia
cactcattcagatctcagggttgctacactcatatcgatcccagaaatctttcgtttttagggagcagatttcctcgcaaatgagcatgtaagtactagtttgaaattatctacactacaacttgacatcaatatcagactctgacagccagggccaaagccatcggatttggttactcatctgctcacacaaattgaaa

SEQ ID NO: 3110 - DNA, 200 bp, Kochia scoparia
tttcaatttgtgtgagcagatgagtaaccaaatccgatggctttggccctggctgtcagagtctgatattgatgtcaagttgtagtgtagataatttcaaactagtacttacatgctcatttgcgaggaaatctgctccctaaaaacgaaagatttctgggatcgatatgagtgtagcaaccctgagatctgaatgagtg

SEQ ID NO: 3111 - DNA, 200 bp, Kochia scoparia
actcatctgctcacacaaattgaaatgtccgggacatagaagaaaaaaatacacctatgatggtcttgcgaaaaactattaaataaagtactatatttatcttcttattagaccattttagatcagagaatgttgcttaaaatatcctaaggaaaaagctcaggctatatgattgtattacaccatattattgatatccc

SEQ ID NO: 3112 - DNA, 200 bp, Kochia scoparia
gggatatcaataatatggtgtaatacaatcatatagcctgagctttttccttaggatattttaagcaacattctctgatctaaaatggtctaataagaagataaatatagtactttatttaatagtttttcgcaagaccatcataggtgtatttttttcttctatgtcccggacatttcaatttgtgtgagcagatgagt

SEQ ID NO: 3113 - DNA, 200 bp, Kochia scoparia
tattacaccatattattgatatcccagagtgcactaagggactggtgaatttggtgttaagcagatgttatcaatcccaactacatcatatcccatctactaggcaggcagcggcaaggcaataatgttagggaaaaaaatcccattatctccattagaaaactatcatattagtctttaaaatttaaacaaaaaggaat

SEQ ID NO: 3114 - DNA, 200 bp, Kochia scoparia
attcctttttgtttaaattttaaagactaatatgatagttttctaatggagataatgggatttttttccctaacattattgccttgccgctgcctgcctagtagatgggatatgatgtagttgggattgataacatctgcttaacaccaaattcaccagtcccttagtgcactctgggatatcaataatatggtgtaata

SEQ ID NO: 3115 - DNA, 200 bp, Kochia scoparia
ctttaaaatttaaacaaaaaggaatttcaaaacaaaatgttgatttcaataggctatgtaacctaagcaatgttaacaagcagaatgctggtttcactagaagagctagtgggctacaggctacaaattatctaagccattcttgtttcctatgattagttttaataggcataatagcataaattcttctatacacatct

SEQ ID NO: 3116 - DNA, 200 bp, Kochia scoparia
agatgtgtatagaagaatttatgctattatgcctattaaaactaatcataggaaacaagaatggcttagataatttgtagcctgtagcccactagctcttctagtgaaaccagcattctgcttgttaacattgcttaggttacatagcctattgaaatcaacattttgttttgaaattcctttttgtttaaattttaaag

SEQ ID NO: 3117 - DNA, 200 bp, Kochia scoparia
agcataaattcttctatacacatctgccggcatttactgcatcactacattacccgttgttgatgaattttttttatgctcttggagggaaaaggtcaattcatagtatttggattgcaaacaatggaatgacaactgttaaatttatcagaagtgttcggacatgggcttatgaaaattttggaacagagaaggctatt

SEQ ID NO: 3118 - DNA, 200 bp, Kochia scoparia
aatagccttctctgttccaaaattttcataagcccatgtccgaacacttctgataaatttaacagttgtcattccattgtttgcaatccaaatactatgaattgaccttttccctccaagagcataaaaaaaattcatcaacaacgggtaatgtagtgatgcagtaaatgccggcagatgtgtatagaagaatttatgct

SEQ ID NO: 3119 - DNA, 200 bp, Kochia scoparia
aaattttggaacagagaaggctattgtattagtagcaatggctactccagaagacatgagaatcaatgttgaacacattcgaattgctcaccagtttgttgaggttcctggtgggactaacaacaactatgccaatgtacaactcattgttgaggtaaatcctgctttagtaacactgatcttccgtgtttttgcactaa

SEQ ID NO: 3120 - DNA, 200 bp, Kochia scoparia
ttagtgcaaaaacacggaagatcagtgttactaaagcaggatttacctcaacaatgagttgtacattggcatagttgttgttagtcccaccaggaacctcaacaaactggtgagcaattcgaatgtgttcaacattgattctcatgtcttctggagtagccattgctactaatacaatagccttctctgttccaaaattt

SEQ ID NO: 3121 - DNA, 200 bp, Kochia scoparia
ctgatcttccgtgtttttgcactaatgttgattataccatttatcttttaaacgtaagccttatacatgaattttccccctacactgttcactgttttttcaattagaacctaaatttgtctttgtttttccctttctctagtctttggattacaaagataataaaattcatacgggttggttagatagtagaattgcaa

SEQ ID NO: 3122 - DNA, 200 bp, Kochia scoparia
ttgcaattctactatctaaccaacccgtatgaattttattatctttgtaatccaaagactagagaaagggaaaaacaaagacaaatttaggttctaattgaaaaaacagtgaacagtgtagggggaaaattcatgtataaggcttacgtttaaaagataaatggtataatcaacattagtgcaaaaacacggaagatcag

SEQ ID NO: 3123 - DNA, 200 bp, Kochia scoparia
ggttggttagatagtagaattgcaatgagagtcagagcggaaaggcccccctggttcatctctgtggggggaggtgcactctacgtgtgtacaacttttctcttaaatttttttccttccaaaagcttgatgtgtcactttcgtttatttttataatgaataattttaaatacttcgtaatttctttctcctttctccct

SEQ ID NO: 3124 - DNA, 200 bp, Kochia scoparia
agggagaaaggagaaagaaattacgaagtatttaaaattattcattataaaaataaacgaaagtgacacatcaagcttttggaaggaaaaaaatttaagagaaaagttgtacacacgtagagtgcacctccccccacagagatgaaccaggggggcctttccgctctgactctcattgcaattctactatctaaccaacc

SEQ ID NO: 3125 - DNA, 200 bp, Kochia scoparia
cgtaatttctttctcctttctccctatcttcagtaagcttcttctagtagtgcagctactgtttcagaatatattggctatcttgagaaaggtcaaattcctccaaaggtaatccaaacaccagatgctgttgagatataattgttttttaaacactaattgtttctttcagtaaattacatcaatatttgtgtggattg

SEQ ID NO: 3126 - DNA, 200 bp, Kochia scoparia
caatccacacaaatattgatgtaatttactgaaagaaacaattagtgtttaaaaaacaattatatctcaacagcatctggtgtttggattacctttggaggaatttgacctttctcaagatagccaatatattctgaaacagtagctgcactactagaagaagcttactgaagatagggagaaaggagaaagaaattacg

SEQ ID NO: 3127 - DNA, 200 bp, Kochia scoparia
attacatcaatatttgtgtggattgcagcatatttcacttgtccacttggaagttactttgaatattgaggggagcaagtacactataagtttattattaagttatgtgaatttcatttttcgttcatggtttctcctgtttacttgatgttaatcatcataacatggttgattctgttctccagatcaaaatggtgaga

SEQ ID NO: 3128 - DNA, 200 bp, Kochia scoparia
tctcaccattttgatctggagaacagaatcaaccatgttatgatgattaacatcaagtaaacaggagaaaccatgaacgaaaaatgaaattcacataacttaataataaacttatagtgtacttgctcccctcaatattcaaagtaacttccaagtggacaagtgaaatatgctgcaatccacacaaatattgatgtaat

SEQ ID NO: 3129 - DNA, 200 bp, Kochia scoparia
actttgtagtttgtagtttgtagtgtgcagtgtgcagtgtgcagtgtcgcattaaaatttgactaatgctaatgcttccctaaaatctctcctaaacatgtgaatttccttaaattaccaccgcaaactccattcaatacttagaattattcccttgaattcgatcctactcttcagtttcatagtttcaacactctttt

SEQ ID NO: 3130 - DNA, 200 bp, Kochia scoparia
aaaagagtgttgaaactatgaaactgaagagtaggatcgaattcaagggaataattctaagtattgaatggagtttgcggtggtaatttaaggaaattcacatgtttaggagagattttagggaagcattagcattagtcaaattttaatgcgacactgcacactgcacactgcacactacaaactacaaactacaaagt

SEQ ID NO: 3131 - DNA, 200 bp, Kochia scoparia
agtttcatagtttcaacactcttttatttaaacttcctacaatcgtcgttctcttttttttttttgtttttcctaggcttcaaatgcagtattattattattattattagtttttcttattttacaactaaattttcatttcaacactcagaaaatttaagatgattccaatttctgagcgttgtcatgttgttaaattt

SEQ ID NO: 3132 - DNA, 200 bp, Kochia scoparia
aaatttaacaacatgacaacgctcagaaattggaatcatcttaaattttctgagtgttgaaatgaaaatttagttgtaaaataagaaaaactaataataataataataatactgcatttgaagcctaggaaaaacaaaaaaaaaaaagagaacgacgattgtaggaagtttaaataaaagagtgttgaaactatgaaact

SEQ ID NO: 3133 - DNA, 200 bp, Kochia scoparia
tgagcgttgtcatgttgttaaatttcctatactcaaatcttcttctcattgccgtctcttatttcacagtgcaaatgggactatgaaatttcaactcaaaaagaggtattttcattttcatttcttagtgtcgtattttcgtaattacgttgatttttgtgtgaattgtatactagtattacaaaggatccatgattaca

SEQ ID NO: 3134 - DNA, 200 bp, Kochia scoparia
tgtaatcatggatcctttgtaatactagtatacaattcacacaaaaatcaacgtaattacgaaaatacgacactaagaaatgaaaatgaaaatacctctttttgagttgaaatttcatagtcccatttgcactgtgaaataagagacggcaatgagaagaagatttgagtataggaaatttaacaacatgacaacgctca

SEQ ID NO: 3135 - DNA, 200 bp, Kochia scoparia
gtattacaaaggatccatgattacatcgttcaattggcatagatgatgaaattgttagaaattttcgtgcaatttgcaatgcttgctttcatgattatttgtgttgttgaagggaaattcttaatcaatctcgagatatgtatttcgggtgacattttcgtaaatgaacaaaaaaccttcaaggaatttattttcacttt

SEQ ID NO: 3136 - DNA, 200 bp, Kochia scoparia
aaagtgaaaataaattccttgaaggttttttgttcatttacgaaaatgtcacccgaaatacatatctcgagattgattaagaatttcccttcaacaacacaaataatcatgaaagcaagcattgcaaattgcacgaaaatttctaacaatttcatcatctatgccaattgaacgatgtaatcatggatcctttgtaatac

SEQ ID NO: 3137 - DNA, 200 bp, Kochia scoparia
ccttcaaggaatttattttcactttatttacgagaatatacatagcttgagattgtttaagaaattcccgatttggaggtatcacttagaatatatatatatatatatttttatttcattattttaatcatggaaaacgatatatactcgctaactcgcatttgaattcacaacttttgtacattgtagctttctttcta

SEQ ID NO: 3138 - DNA, 200 bp, Kochia scoparia
tagaaagaaagctacaatgtacaaaagttgtgaattcaaatgcgagttagcgagtatatatcgttttccatgattaaaataatgaaataaaaatatatatatatatatattctaagtgatacctccaaatcgggaatttcttaaacaatctcaagctatgtatattctcgtaaataaagtgaaaataaattccttgaagg

SEQ ID NO: 3139 - DNA, 200 bp, Kochia scoparia
tttgtacattgtagctttctttctaggatgcataaagaacttgacactaccaactaaccggtgtttacgatgaatcatacccttttctttgagctgattttgggatgtgtcttttatattggggttggtttttggtagtgtgtagttgagctaaattaaagctctctttggtaagaagtaaaatttttttgatgcaaagt

SEQ ID NO: 3140 - DNA, 200 bp, Kochia scoparia
actttgcatcaaaaaaattttacttcttaccaaagagagctttaatttagctcaactacacactaccaaaaaccaaccccaatataaaagacacatcccaaaatcagctcaaagaaaagggtatgattcatcgtaaacaccggttagttggtagtgtcaagttctttatgcatcctagaaagaaagctacaatgtacaaa

SEQ ID NO: 3141 - DNA, 200 bp, Kochia scoparia
aagtaaaatttttttgatgcaaagtgttttcgacaattttctaattttatattgtttggttgacaaaggagtgtaaaaccattttacatggaaaacttttccaacaatattttgtacactcttgtggctacctctttgcactccttcattttcgctatttcccatattgtttatgatgcaatcaaataatggaaaattgc

SEQ ID NO: 3142 - DNA, 200 bp, Kochia scoparia
gcaattttccattatttgattgcatcataaacaatatgggaaatagcgaaaatgaaggagtgcaaagaggtagccacaagagtgtacaaaatattgttggaaaagttttccatgtaaaatggttttacactcctttgtcaaccaaacaatataaaattagaaaattgtcgaaaacactttgcatcaaaaaaattttactt

SEQ ID NO: 3143 - DNA, 200 bp, Kochia scoparia
atgcaatcaaataatggaaaattgcttccatgtaaattgctttccattctaaattgttttccttgaaaatcattttacattgtaaatattttacgccaaaccaaaattgaccctaggagtaatatagtgtgaatttatcatattgttatattcggtaatgcatactagataattgtggttcattttagttgttacttact

SEQ ID NO: 3144 - DNA, 200 bp, Kochia scoparia
agtaagtaacaactaaaatgaaccacaattatctagtatgcattaccgaatataacaatatgataaattcacactatattactcctagggtcaattttggtttggcgtaaaatatttacaatgtaaaatgattttcaaggaaaacaatttagaatggaaagcaatttacatggaagcaattttccattatttgattgcat

SEQ ID NO: 3145 - DNA, 200 bp, Kochia scoparia
tggttcattttagttgttacttactcttctaactgtcgagtgattaatacaagtatgtgtagtccaaagtatttatattttttaaaattaaaaaaaattgcattagattgttggctcttgaattctacttgactcttgaatgtatgagtcaaaataaaacaattattagtatgtagcttttataccataatagttctgca

SEQ ID NO: 3146 - DNA, 200 bp, Kochia scoparia
tgcagaactattatggtataaaagctacatactaataattgttttattttgactcatacattcaagagtcaagtagaattcaagagccaacaatctaatgcaattttttttaattttaaaaaatataaatactttggactacacatacttgtattaatcactcgacagttagaagagtaagtaacaactaaaatgaacca

SEQ ID NO: 3147 - DNA, 200 bp, Kochia scoparia
gcttttataccataatagttctgcatttcaaacaaccagtatgttctattccttttagtataaattaattctctctttctctgttaatattgtagttgtgtggtaaaatatgttaattacccaattaaaaagctgcaatcttgcaataatatgagtattgcttatgatagtagctcatgtgtttcaaagcttgtatcatt

SEQ ID NO: 3148 - DNA, 200 bp, Kochia scoparia
aatgatacaagctttgaaacacatgagctactatcataagcaatactcatattattgcaagattgcagctttttaattgggtaattaacatattttaccacacaactacaatattaacagagaaagagagaattaatttatactaaaaggaatagaacatactggttgtttgaaatgcagaactattatggtataaaagc

SEQ ID NO: 3149 - DNA, 200 bp, Kochia scoparia
catgtgtttcaaagcttgtatcattttagtaagactatttgttttatgtaatacaaggttgttgtagcttgattacttttgacatgtagaatatgcatatcgtgtgaaaattgggaatgctattcatgtgataaattactcgtactctttcatttatctcacgtgggctgtgtcgacacgacttgtgtcggacaacaccg

SEQ ID NO: 3150 - DNA, 200 bp, Kochia scoparia
cggtgttgtccgacacaagtcgtgtcgacacagcccacgtgagataaatgaaagagtacgagtaatttatcacatgaatagcattcccaattttcacacgatatgcatattctacatgtcaaaagtaatcaagctacaacaaccttgtattacataaaacaaatagtcttactaaaatgatacaagctttgaaacacatg

SEQ ID NO: 3151 - DNA, 200 bp, Kochia scoparia
acacgacttgtgtcggacaacaccgacacgcgatacttcaatcttttaactttaaacactacttttttcaagaaaatgggcgagtccgattcctggacaccaatgtcgaatttgacacttcatccaagtccaagtaacatagttcatgtgatatgatgtgattagcatgctgatcagtgttttattagatgatattgatt

SEQ ID NO: 3152 - DNA, 200 bp, Kochia scoparia
aatcaatatcatctaataaaacactgatcagcatgctaatcacatcatatcacatgaactatgttacttggacttggatgaagtgtcaaattcgacattggtgtccaggaatcggactcgcccattttcttgaaaaaagtagtgtttaaagttaaaagattgaagtatcgcgtgtcggtgttgtccgacacaagtcgtgt

SEQ ID NO: 3153 - DNA, 200 bp, Kochia scoparia
agtgttttattagatgatattgattcaacatattggtgtaacagttataggaaaagtgggcgtattttttgccaagggcagggcggaatgttatctagggaagacccaaataaggcaacttcggagggaaaaattgattaccccaacagaacaactcttttgaggaaatctgctacattacctgttgatgaattacctgt

SEQ ID NO: 3154 - DNA, 200 bp, Kochia scoparia
acaggtaattcatcaacaggtaatgtagcagatttcctcaaaagagttgttctgttggggtaatcaatttttccctccgaagttgccttatttgggtcttccctagataacattccgccctgcccttggcaaaaaatacgcccacttttcctataactgttacaccaatatgttgaatcaatatcatctaataaaacact

SEQ ID NO: 3155 - DNA, 200 bp, Kochia scoparia
cattacctgttgatgaattacctgttgatgaattttgttatgctcttggagggaaaagaccgattcgtagtattttgattgcaaacaatggaatggcagctgttaaatttataagaagcattcggacatgggcttatgagaccttcggaacagagaaggctattgtattagtagcaatagctactccagaagacatgaga

SEQ ID NO: 3156 - DNA, 200 bp, Kochia scoparia
tctcatgtcttctggagtagctattgctactaatacaatagccttctctgttccgaaggtctcataagcccatgtccgaatgcttcttataaatttaacagctgccattccattgtttgcaatcaaaatactacgaatcggtcttttccctccaagagcataacaaaattcatcaacaggtaattcatcaacaggtaatg

SEQ ID NO: 3157 - DNA, 200 bp, Kochia scoparia
aatagctactccagaagacatgagaatcaacgctgaacacattcgaatggctgaccagtttgttgaggttcctggtgggactaacaacaacaactatgccaatgtgcagctcattgttgaggtaaatcctattttactaacactgatcttcattgttttctctgatagaatatcggtttataagaaaagttataaccttg

SEQ ID NO: 3158 - DNA, 200 bp, Kochia scoparia
caaggttataacttttcttataaaccgatattctatcagagaaaacaatgaagatcagtgttagtaaaataggatttacctcaacaatgagctgcacattggcatagttgttgttgttagtcccaccaggaacctcaacaaactggtcagccattcgaatgtgttcagcgttgattctcatgtcttctggagtagctatt

SEQ ID NO: 3159 - DNA, 200 bp, Kochia scoparia
gtttataagaaaagttataaccttgcttgttggcctgttgatgtggttcacattaaacaaccttggttcatcataggtagttcaagctccaacagttcatcgttaacacacattaattcaagtatctgttaatcattgatctcagagggtaaaccattgttaaaaggacttcaatttattttcactgcttttcagatggc

SEQ ID NO: 3160 - DNA, 200 bp, Kochia scoparia
gccatctgaaaagcagtgaaaataaattgaagtccttttaacaatggtttaccctctgagatcaatgattaacagatacttgaattaatgtgtgttaacgatgaactgttggagcttgaactacctatgatgaaccaaggttgtttaatgtgaaccacatcaacaggccaacaagcaaggttataacttttcttataaac

SEQ ID NO: 3161 - DNA, 200 bp, Kochia scoparia
ttattttcactgcttttcagatggcagagatgacacgtgttgatgctgtttggccaggctggggacatgcatcggagaaccctgagcttccagatgcactaaacgcgaaggggattgaatttctagggcctccagctaaatctatggctgctcttggagacaaaattggttcatcattgattgctcaggccgcagatgtt

SEQ ID NO: 3162 - DNA, 200 bp, Kochia scoparia
aacatctgcggcctgagcaatcaatgatgaaccaattttgtctccaagagcagccatagatttagctggaggccctagaaattcaatccccttcgcgtttagtgcatctggaagctcagggttctccgatgcatgtccccagcctggccaaacagcatcaacacgtgtcatctctgccatctgaaaagcagtgaaaataa

SEQ ID NO: 3163 - DNA, 200 bp, Kochia scoparia
attgattgctcaggccgcagatgttccaactcttccatggagtggctctcatgtatgcattgattttcttattgaccttgacaagctttctttttctcgaggagtttgctaatccgttttcttaaatttctaatctttaggtgaaagctcctgctgagagttgccttgattctattcctgatgacatatacaaggcagcc

SEQ ID NO: 3164 - DNA, 200 bp, Kochia scoparia
ggctgccttgtatatgtcatcaggaatagaatcaaggcaactctcagcaggagctttcacctaaagattagaaatttaagaaaacggattagcaaactcctcgagaaaaagaaagcttgtcaaggtcaataagaaaatcaatgcatacatgagagccactccatggaagagttggaacatctgcggcctgagcaatcaat

SEQ ID NO: 3165 - DNA, 200 bp, Kochia scoparia
tcctgatgacatatacaaggcagcctgtgtttttaccacagaggaagcagttgctagttgtcaggttgtcggttatccagctatgattaaagcatcttggggtggtggagggaaaggaataagaaaggtgagctagttgtttgggatgatgtcgtcaagaaattaaagcaccggcttcaatgcttatttatcaccctttt

SEQ ID NO: 3166 - DNA, 200 bp, Kochia scoparia
aaaagggtgataaataagcattgaagccggtgctttaatttcttgacgacatcatcccaaacaactagctcacctttcttattcctttccctccaccaccccaagatgctttaatcatagctggataaccgacaacctgacaactagcaactgcttcctctgtggtaaaaacacaggctgccttgtatatgtcatcagga

SEQ ID NO: 3167 - DNA, 200 bp, Kochia scoparia
ttcaatgcttatttatcacccttttcacagcttccatccttggacatccttttaattaactgtccattaatatttacttgacttaaatgatggacaaatgcttcaaacttgttagttagagacccgttgtgctatttcaattacaatcgtctttctctcaaaatatcacaaagactcaatagttatgcattttcaggtgc

SEQ ID NO: 3168 - DNA, 200 bp, Kochia scoparia
gcacctgaaaatgcataactattgagtctttgtgatattttgagagaaagacgattgtaattgaaatagcacaacgggtctctaactaacaagtttgaagcatttgtccatcatttaagtcaagtaaatattaatggacagttaattaaaaggatgtccaaggatggaagctgtgaaaagggtgataaataagcattgaa

SEQ ID NO: 3169 - DNA, 200 bp, Kochia scoparia
tcaatagttatgcattttcaggtgcataatgatgatgaagtaagggcattgttcaagcaagtgcagggcgaagttcctggctctcccatatttataatgaaggtggcttcacaggttagttattctgcaaattggtgctagaatgtatcatataagtactcacaagtccatggcactcatgattttagaactagtactgt

SEQ ID NO: 3170 - DNA, 200 bp, Kochia scoparia
acagtactagttctaaaatcatgagtgccatggacttgtgagtacttatatgatacattctagcaccaatttgcagaataactaacctgtgaagccaccttcattataaatatgggagagccaggaacttcgccctgcacttgcttgaacaatgcccttacttcatcatcattatgcacctgaaaatgcataactattga

SEQ ID NO: 3171 - DNA, 200 bp, Kochia scoparia
ctcatgattttagaactagtactgtatgcaaaattctttgattttgacaagttattatatgtgcttcagagtcgacacttagaagtgcagttaatttgtgatcaatatggcaatgtagcagcattacatagccgtgattgcagtgtccaaaggcggcaccagaaggtgggtcactagtgtactatcaataaatttttaat

SEQ ID NO: 3172 - DNA, 200 bp, Kochia scoparia
attaaaaatttattgatagtacactagtgacccaccttctggtgccgcctttggacactgcaatcacggctatgtaatgctgctacattgccatattgatcacaaattaactgcacttctaagtgtcgactctgaagcacatataataacttgtcaaaatcaaagaattttgcatacagtactagttctaaaatcatgag

SEQ ID NO: 3173 - DNA, 200 bp, Kochia scoparia
agtgtactatcaataaatttttaatcttcttgaccagttttgtattacttagggtctaaagttgtttttttcatagagaatcgtgatgctcattgttcattgaaggaatgtataaatgatcttgttcattgtattaattgatcagattattgaagagggtccaataaatgtagctccccaagaaactgtgataaaacttg

SEQ ID NO: 3174 - DNA, 200 bp, Kochia scoparia
caagttttatcacagtttcttggggagctacatttattggaccctcttcaataatctgatcaattaatacaatgaacaagatcatttatacattccttcaatgaacaatgagcatcacgattctctatgaaaaaaacaactttagaccctaagtaatacaaaactggtcaagaagattaaaaatttattgatagtacact

SEQ ID NO: 3175 - DNA, 200 bp, Kochia scoparia
ccccaagaaactgtgataaaacttgagcaggcagccagaaggttagccaaatatgtgaattttgttggagcagcaactgtagaatatctatacagcatggaaactggcgagttttatttcctcgagctaaaccctcggctacaggtatgaagcatacacttgcacattgtatattcatatttacctcgaataattactca

SEQ ID NO: 3176 - DNA, 200 bp, Kochia scoparia
tgagtaattattcgaggtaaatatgaatatacaatgtgcaagtgtatgcttcatacctgtagccgagggtttagctcgaggaaataaaactcgccagtttccatgctgtatagatattctacagttgctgctccaacaaaattcacatatttggctaaccttctggctgcctgctcaagttttatcacagtttcttgggg

SEQ ID NO: 3177 - DNA, 200 bp, Kochia scoparia
catatttacctcgaataattactcaagaaagaaaatgttttatgtcaatatttatggcattgcatctcaatatcctttggatttatcgttttctaccttacgtttgtggctcactttaatatgacttgcttttgttaaggagccttgggatttcttagagtgagatatgacactcttgcctttcaacttttgtgaaccat

SEQ ID NO: 3178 - DNA, 200 bp, Kochia scoparia
atggttcacaaaagttgaaaggcaagagtgtcatatctcactctaagaaatcccaaggctccttaacaaaagcaagtcatattaaagtgagccacaaacgtaaggtagaaaacgataaatccaaaggatattgagatgcaatgccataaatattgacataaaacattttctttcttgagtaattattcgaggtaaatatg

SEQ ID NO: 3179 - DNA, 200 bp, Kochia scoparia
ttgcctttcaacttttgtgaaccatgtctgatactccctccatttccttttgtttgtttgatttatatcttgaggggtgatattattcataggtagagagattcctctaaatttataagatgagacatagctctgaggggtcttgttgaattcatcttgatgagtactttaaatcaaagccttgatgagtacttcaataa

SEQ ID NO: 3180 - DNA, 200 bp, Kochia scoparia
ttattgaagtactcatcaaggctttgatttaaagtactcatcaagatgaattcaacaagacccctcagagctatgtctcatcttataaatttagaggaatctctctacctatgaataatatcacccctcaagatataaatcaaacaaacaaaaggaaatggagggagtatcagacatggttcacaaaagttgaaaggcaa

SEQ ID NO: 3181 - DNA, 200 bp, Kochia scoparia
aaagccttgatgagtacttcaataatattaaatttttagaatttttattcttatatagttaaagatactaacaactaaaaatttgctccaacaaatgtgtgataatgaatcgggacaaaagaagggaatggagggagtattactaagaattagcaatcctatatgatcatgtgatggatgaaaaaatcttattgaagact

SEQ ID NO: 3182 - DNA, 200 bp, Kochia scoparia
agtcttcaataagattttttcatccatcacatgatcatataggattgctaattcttagtaatactccctccattcccttcttttgtcccgattcattatcacacatttgttggagcaaatttttagttgttagtatctttaactatataagaataaaaattctaaaaatttaatattattgaagtactcatcaaggcttt

SEQ ID NO: 3183 - DNA, 200 bp, Kochia scoparia
ggatgaaaaaatcttattgaagacttttctgataatattgtatataatgtctgacatatgtgtaggttttattatatttaattttaaaaaattcctgtttggaaaatccggttaattttattggttatttatctaattccttcttttgttcgcgtttgataaatacaggtggagcacccagtaactgaatggattgctgg

SEQ ID NO: 3184 - DNA, 200 bp, Kochia scoparia
ccagcaatccattcagttactgggtgctccacctgtatttatcaaacgcgaacaaaagaaggaattagataaataaccaataaaattaaccggattttccaaacaggaattttttaaaattaaatataataaaacctacacatatgtcagacattatatacaatattatcagaaaagtcttcaataagattttttcatcc

SEQ ID NO: 3185 - DNA, 200 bp, Kochia scoparia
acccagtaactgaatggattgctggaattaaccttccagctgctcaggttgcagttggcatgggtattcccctctggcaaattccaggtagctagcatgttccctttctgattatcgaacttatgtgcttcatgttgttcttgtgcatgattgtgcttgcttttgaattatcaaaatagaaattcggcgattctatggta

SEQ ID NO: 3186 - DNA, 200 bp, Kochia scoparia
taccatagaatcgccgaatttctattttgataattcaaaagcaagcacaatcatgcacaagaacaacatgaagcacataagttcgataatcagaaagggaacatgctagctacctggaatttgccagaggggaatacccatgccaactgcaacctgagcagctggaaggttaattccagcaatccattcagttactgggt

SEQ ID NO: 3187 - DNA, 200 bp, Kochia scoparia
atagaaattcggcgattctatggtaaggaacatggtgggggttatgatgcttggagaagaacatcaattgctgcgactgcttttaattttgacaaggcacaatctgtgaaaccgaaaggtcactgtattgccgtacgtgtgacaagtgaggaccctgatgatggattcaagcccactagtgggaaagtacaggttagtaa

SEQ ID NO: 3188 - DNA, 200 bp, Kochia scoparia
ttactaacctgtactttcccactagtgggcttgaatccatcatcagggtcctcacttgtcacacgtacggcaatacagtgacctttcggtttcacagattgtgccttgtcaaaattaaaagcagtcgcagcaattgatgttcttctccaagcatcataacccccaccatgttccttaccatagaatcgccgaatttctat

SEQ ID NO: 3189 - DNA, 200 bp, Kochia scoparia
ctagtgggaaagtacaggttagtaatactagtgtttaacagttcaaactacactctcaattgactgccttgtctgttttgtgattcatgtaaaattatttatttcattggttccttttctaggagttgattttcaaaagtaaaccaaatatgtgggcctatttctctataaaggtatgtctttattcttcaattttcaca

SEQ ID NO: 3190 - DNA, 200 bp, Kochia scoparia
tgtgaaaattgaagaataaagacatacctttatagagaaataggcccacatatttggtttacttttgaaaatcaactcctagaaaaggaaccaatgaaataaataattttacatgaatcacaaaacagacaaggcagtcaattgagagtgtagtttgaactgttaaacactagtattactaacctgtactttcccactag

SEQ ID NO: 3191 - DNA, 200 bp, Kochia scoparia
atgtctttattcttcaattttcacatcatccttttatggattcatccacgagcttaacaatgatcaacattgtgacgcagtctgggggaggcattcatgagttctcagattctcaatttggtaagtttaaagcacattttaaagatgactagcaatgaaatgacaattatagctgccttttaagaatgaagttcttcaac

SEQ ID NO: 3192 - DNA, 200 bp, Kochia scoparia
gttgaagaacttcattcttaaaaggcagctataattgtcatttcattgctagtcatctttaaaatgtgctttaaacttaccaaattgagaatctgagaactcatgaatgcctcccccagactgcgtcacaatgttgatcattgttaagctcgtggatgaatccataaaaggatgatgtgaaaattgaagaataaagacat

SEQ ID NO: 3193 - DNA, 200 bp, Kochia scoparia
ccttttaagaatgaagttcttcaacatcatattaggggttctctaatttaagtctgctgcaaatggataaggaactatgctgttgtacatgtgaaatgagatatattggtttttcgtagtgtgtcacagcagacggtaaatgctcttgttaattgttgatgattaattgggatttagcattcatggtgtaatctgctctt

SEQ ID NO: 3194 - DNA, 200 bp, Kochia scoparia
aagagcagattacaccatgaatgctaaatcccaattaatcatcaacaattaacaagagcatttaccgtctgctgtgacacactacgaaaaaccaatatatctcatttcacatgtacaacagcatagttccttatccatttgcagcagacttaaattagagaacccctaatatgatgttgaagaacttcattcttaaaagg

SEQ ID NO: 3195 - DNA, 200 bp, Kochia scoparia
agcattcatggtgtaatctgctcttgcactatcaagtctcatggaattaacatgtcattttttttatcgattatttttggttttaaaacatcctttatctattttttttattttttttatagaaggctaatgttagttaatttgtttgtaggtcatgtctttgcatttggtgaatcaagagggttggccatagcaaatat

SEQ ID NO: 3196 - DNA, 200 bp, Kochia scoparia
atatttgctatggccaaccctcttgattcaccaaatgcaaagacatgacctacaaacaaattaactaacattagccttctataaaaaaaataaaaaaaatagataaaggatgttttaaaaccaaaaataatcgataaaaaaaatgacatgttaattccatgagacttgatagtgcaagagcagattacaccatgaatgct

SEQ ID NO: 3197 - DNA, 200 bp, Kochia scoparia
caagagggttggccatagcaaatatggttcttggcttgaaagaaattcaaattcgtggagaaattcgcactaatgttgattataccattgatcttttaaacgtgagccttgtacatgattttttttcctccctacactttccactgttttttcaattagaagctaaacttgtcttcgtttttcctttctccagtcttcgg

SEQ ID NO: 3198 - DNA, 200 bp, Kochia scoparia
ccgaagactggagaaaggaaaaacgaagacaagtttagcttctaattgaaaaaacagtggaaagtgtagggaggaaaaaaaatcatgtacaaggctcacgtttaaaagatcaatggtataatcaacattagtgcgaatttctccacgaatttgaatttctttcaagccaagaaccatatttgctatggccaaccctcttg

SEQ ID NO: 3199 - DNA, 200 bp, Kochia scoparia
cgtttttcctttctccagtcttcggattacagagataataaaattcatacaggttggttagatagcagaattgcaatgagagtgaaagcggaaagacccccctggttcatctctgttgtgggaggagcactctacgtatgtacaactttttttctctaaaatttgtttccttccaaaagattcacatgtcatttttcgtc

SEQ ID NO: 3200 - DNA, 200 bp, Kochia scoparia
gacgaaaaatgacatgtgaatcttttggaaggaaacaaattttagagaaaaaaagttgtacatacgtagagtgctcctcccacaacagagatgaaccaggggggtctttccgctttcactctcattgcaattctgctatctaaccaacctgtatgaattttattatctctgtaatccgaagactggagaaaggaaaaacg

SEQ ID NO: 3201 - DNA, 200 bp, Kochia scoparia
aaagattcacatgtcatttttcgtctttttttataacgaataattttaaatgatttctctcttctttctccctatcttcagaaagcttttgctagtagtgcagctacagtttcagaatatgttggctatcttgagaaaggtcaaattcctccaaaggtaattcaagcaccagatgctgttgaggtatactggttttttta

SEQ ID NO: 3202 - DNA, 200 bp, Kochia scoparia
taaaaaaaccagtatacctcaacagcatctggtgcttgaattacctttggaggaatttgacctttctcaagatagccaacatattctgaaactgtagctgcactactagcaaaagctttctgaagatagggagaaagaagagagaaatcatttaaaattattcgttataaaaaaagacgaaaaatgacatgtgaatcttt

SEQ ID NO: 3203 - DNA, 200 bp, Kochia scoparia
ctgttgaggtatactggtttttttaaacactaattgtttctttcagtaaattacatcaatttttgtgtggattgcagcatatatcacttgtccactctgaagtttctctgaatattgaggggagcaagtacactgtaagtatattattataactgatgtgaattttatatttcatttttcgatttcgtctgttttcttgt

SEQ ID NO: 3204 - DNA, 200 bp, Kochia scoparia
acaagaaaacagacgaaatcgaaaaatgaaatataaaattcacatcagttataataatatacttacagtgtacttgctcccctcaatattcagagaaacttcagagtggacaagtgatatatgctgcaatccacacaaaaattgatgtaatttactgaaagaaacaattagtgtttaaaaaaaccagtatacctcaacag

SEQ ID NO: 3205 - DNA, 200 bp, Kochia scoparia
ttttcgatttcgtctgttttcttgttaatcatcataacatggttaatgctgttctctagattaaagtggtgaggggcggtccaggaaactacagattgagattgaatgagtctgagattgaggctgaaatacatccattaagagatgggggtcttttgatgcaagtaagaacttaacttttattcattcatatattcatg

SEQ ID NO: 3206 - DNA, 200 bp, Kochia scoparia
catgaatatatgaatgaataaaagttaagttcttacttgcatcaaaagacccccatctcttaatggatgtatttcagcctcaatctcagactcattcaatctcaatctgtagtttcctggaccgcccctcaccactttaatctagagaacagcattaaccatgttatgatgattaacaagaaaacagacgaaatcgaaaa

SEQ ID NO: 3207 - DNA, 200 bp, Kochia scoparia
acttttattcattcatatattcatgattgagggcaattgtcaaattatacacatataggagttataatatgtgtagagttaaaattgcgagtgaaagctgagatattactcgatgtatttagtatatcattcaccatagaatgcttgagttacttgcgttaaattaaaaaaaaaaaggaaagagtagaaattagagagtc

SEQ ID NO: 3208 - DNA, 200 bp, Kochia scoparia
gactctctaatttctactctttcctttttttttttaatttaacgcaagtaactcaagcattctatggtgaatgatatactaaatacatcgagtaatatctcagctttcactcgcaattttaactctacacatattataactcctatatgtgtataatttgacaattgccctcaatcatgaatatatgaatgaataaaagt

SEQ ID NO: 3209 - DNA, 200 bp, Kochia scoparia
aggaaagagtagaaattagagagtctaaagtttctgtggtcataatgatatgtctaattgaacgcaccccaatgtgtttcagttatttttttacccctaacttaggagggaaaactgacttagcggcttcccctctagcataggatataagtgctccaaactcttagaatatctaaatttgaaaaacttataatgtatta

SEQ ID NO: 3210 - DNA, 200 bp, Kochia scoparia
taatacattataagtttttcaaatttagatattctaagagtttggagcacttatatcctatgctagaggggaagccgctaagtcagttttccctcctaagttaggggtaaaaaaataactgaaacacattggggtgcgttcaattagacatatcattatgaccacagaaactttagactctctaatttctactctttcct

SEQ ID NO: 3211 - DNA, 200 bp, Kochia scoparia
aatttgaaaaacttataatgtattattgacattctttcagagaatgcttttctgtgtgaactccttaagtatgttaatagcaatcccgcaaccctgtttcacattatataggtatttgtttcttattagatgatattccatatctccatataagatctttcttcttaccaattcaagccatatattttttggattaagaa

SEQ ID NO: 3212 - DNA, 200 bp, Kochia scoparia
ttcttaatccaaaaaatatatggcttgaattggtaagaagaaagatcttatatggagatatggaatatcatctaataagaaacaaatacctatataatgtgaaacagggttgcgggattgctattaacatacttaaggagttcacacagaaaagcattctctgaaagaatgtcaataatacattataagtttttcaaatt

SEQ ID NO: 3213 - DNA, 200 bp, Kochia scoparia
agccatatattttttggattaagaagatgatattcacaaaaggtttgcgttatgatgatacttaatatacccacatgtttcatattttcattgacttaaacgctatttcttagaaaagttggagttgttgatccaatgtatgtgctggtttctcatccctttgttttcaattagctatggattttgagctcttctgtaca

SEQ ID NO: 3214 - DNA, 200 bp, Kochia scoparia
tgtacagaagagctcaaaatccatagctaattgaaaacaaagggatgagaaaccagcacatacattggatcaacaactccaacttttctaagaaatagcgtttaagtcaatgaaaatatgaaacatgtgggtatattaagtatcatcataacgcaaaccttttgtgaatatcatcttcttaatccaaaaaatatatggct

SEQ ID NO: 3215 - DNA, 200 bp, Kochia scoparia
tatggattttgagctcttctgtacatttgaatgtgatgtagttggatgggaaaagtcacgtgatatatgctcaggaagaggcagcaggaactcgccttcttattgatggacgaacgtgtttgcttcaggtaccatcatgttatttaattgcatagtatttctaaacatttaccaagcgtaacatgctattacattttcca

SEQ ID NO: 3216 - DNA, 200 bp, Kochia scoparia
tggaaaatgtaatagcatgttacgcttggtaaatgtttagaaatactatgcaattaaataacatgatggtacctgaagcaaacacgttcgtccatcaataagaaggcgagttcctgctgcctcttcctgagcatatatcacgtgacttttcccatccaactacatcacattcaaatgtacagaagagctcaaaatccata

SEQ ID NO: 3217 - DNA, 200 bp, Kochia scoparia
gcgtaacatgctattacattttccacttcttcaatattcagaatgatcatgatccttcaaagttaattgtggaaacaccttgtaagctactgcggtatctggttccagatgatagtcatgttgatccagatactccttttgctgaagttgaggttatgaagatgtgtatgcctttgctttcccctgcatctggtaaaata

SEQ ID NO: 3218 - DNA, 200 bp, Kochia scoparia
tattttaccagatgcaggggaaagcaaaggcatacacatcttcataacctcaacttcagcaaaaggagtatctggatcaacatgactatcatctggaaccagataccgcagtagcttacaaggtgtttccacaattaactttgaaggatcatgatcattctgaatattgaagaagtggaaaatgtaatagcatgttacgc

SEQ ID NO: 3219 - DNA, 200 bp, Kochia scoparia
gctttcccctgcatctggtaaaataagatttaagatgtccgaaggacaacccatgcaggttagcataggttttagtagatcgatatgttaactaaatatacttcaaaagtttcttctaagtgaaggttcactgtgtaggctggcgaactcatagcaaaacttgagttggatgatccttcagctgtaagaaaagctgaacc

SEQ ID NO: 3220 - DNA, 200 bp, Kochia scoparia
ggttcagcttttcttacagctgaaggatcatccaactcaagttttgctatgagttcgccagcctacacagtgaaccttcacttagaagaaacttttgaagtatatttagttaacatatcgatctactaaaacctatgctaacctgcatgggttgtccttcggacatcttaaatcttattttaccagatgcaggggaaagc

SEQ ID NO: 3221 - DNA, 200 bp, Kochia scoparia
cttcagctgtaagaaaagctgaaccgttccgtggtagttttccaaccttgcatccgccaactgctatctcagaaaaggttcatcaaaaatttgttgcaagtttgaatgcagcccagatgattcttgctggttttgaacacaacatagatgaagtaagtattttaattgtgaattcaaaaatattgagcactatattatat

SEQ ID NO: 3222 - DNA, 200 bp, Kochia scoparia
atataatatagtgctcaatatttttgaattcacaattaaaatacttacttcatctatgttgtgttcaaaaccagcaagaatcatctgggctgcattcaaacttgcaacaaatttttgatgaaccttttctgagatagcagttggcggatgcaaggttggaaaactaccacggaacggttcagcttttcttacagctgaag

SEQ ID NO: 3223 - DNA, 200 bp, Kochia scoparia
aaaaatattgagcactatattatatagatgaagtatttcagttatgaattaagcatagatgatgtgagtattactctaagggggctgatgcaaaaatttgagagtaaatgtatatttatattttgtttggttcccttatctgaaagattctttacaaaagagttttctaattctcaggttgtccagagtttgttgaggtg

SEQ ID NO: 3224 - DNA, 200 bp, Kochia scoparia
cacctcaacaaactctggacaacctgagaattagaaaactcttttgtaaagaatctttcagataagggaaccaaacaaaatataaatatacatttactctcaaatttttgcatcagcccccttagagtaatactcacatcatctatgcttaattcataactgaaatacttcatctatataatatagtgctcaatattttt

SEQ ID NO: 3225 - DNA, 200 bp, Kochia scoparia
aggttgtccagagtttgttgaggtgccttgatagtcctgaacttcctttcttgcaatggcaagaatgcttgtctgttctagcaacacggcttcccaaagatctgagaactgaagtatgttactaaaatctgtatgcaatttttttccatatttgataaacacctgctgtctttagcagtctttatcttctttggtctttc

SEQ ID NO: 3226 - DNA, 200 bp, Kochia scoparia
gaaagaccaaagaagataaagactgctaaagacagcaggtgtttatcaaatatggaaaaaaattgcatacagattttagtaacatacttcagttctcagatctttgggaagccgtgttgctagaacagacaagcattcttgccattgcaagaaaggaagttcaggactatcaaggcacctcaacaaactctggacaacct

SEQ ID NO: 3227 - DNA, 200 bp, Kochia scoparia
cagtctttatcttctttggtctttccctctctctctctctctctctctcaccctgtgtataattcacattatttttccatgtttccctgtctttggtattctcagttggaatcaaagtgtcgaaaattcacaggaattacgaattctcataacattgaatttcctgctatggtgtttaaaggtgttcttgaggttagtct

SEQ ID NO: 3228 - DNA, 200 bp, Kochia scoparia
agactaacctcaagaacacctttaaacaccatagcaggaaattcaatgttatgagaattcgtaattcctgtgaattttcgacactttgattccaactgagaataccaaagacagggaaacatggaaaaataatgtgaattatacacagggtgagagagagagagagagagagagggaaagaccaaagaagataaagactg

SEQ ID NO: 3229 - DNA, 200 bp, Kochia scoparia
ttaaaggtgttcttgaggttagtctttctttttgctacccttctatatatgctatatattttagtattacttacataagtattttgtttacaggcccatttgaattcatgccctgaaaaggagagaggagctcaagagcggctcattgaacctctaatgagtcttgttaaatcctatgaaggtgggagagagagtcatgc

SEQ ID NO: 3230 - DNA, 200 bp, Kochia scoparia
gcatgactctctctcccaccttcataggatttaacaagactcattagaggttcaatgagccgctcttgagctcctctctccttttcagggcatgaattcaaatgggcctgtaaacaaaatacttatgtaagtaatactaaaatatatagcatatatagaagggtagcaaaaagaaagactaacctcaagaacacctttaa

SEQ ID NO: 3231 - DNA, 200 bp, Kochia scoparia
atgaaggtgggagagagagtcatgcccatgttattgttcagtctctgtttgaagagtatttgtctgttgaagaattgttcagtgtcaatatccaggtttgttattgccgtgcaaattaatcagtttatcgatgatcattggtctttatgttttttcctcgattggtagattggttatgatgttatgactctagagtaaag

SEQ ID NO: 3232 - DNA, 200 bp, Kochia scoparia
ctttactctagagtcataacatcataaccaatctaccaatcgaggaaaaaacataaagaccaatgatcatcgataaactgattaatttgcacggcaataacaaacctggatattgacactgaacaattcttcaacagacaaatactcttcaaacagagactgaacaataacatgggcatgactctctctcccaccttcat

SEQ ID NO: 3233 - DNA, 200 bp, Kochia scoparia
atgatgttatgactctagagtaaaggtggaaccagaaaaatgttttggagggggccaaaatatttgttttgtattattggagggggccgaatacaaaaattagcttaatttttcccatatttaacctattttttaaagaaaaataaaaaattggcgggagtcgtggcccccacccgcccccatgttctgccattgcccta

SEQ ID NO: 3234 - DNA, 200 bp, Kochia scoparia
tagggcaatggcagaacatgggggcgggtgggggccacgactcccgccaattttttatttttctttaaaaaataggttaaatatgggaaaaattaagctaatttttgtattcggccccctccaataatacaaaacaaatattttggccccctccaaaacatttttctggttccacctttactctagagtcataacatcat

SEQ ID NO: 3235 - DNA, 200 bp, Kochia scoparia
gcccccatgttctgccattgccctagaggctacagaatctttggagtaccttatgtctcagtgaattatagtagcatcctttgaagtattactttgttttttcaagaaatagcagttcatgtctttggttgttggcttgtaatttgtgcactgtaatgcaagcttaggactagaagaaacagtttatttatacgctatga

SEQ ID NO: 3236 - DNA, 200 bp, Kochia scoparia
tcatagcgtataaataaactgtttcttctagtcctaagcttgcattacagtgcacaaattacaagccaacaaccaaagacatgaactgctatttcttgaaaaaacaaagtaatacttcaaaggatgctactataattcactgagacataaggtactccaaagattctgtagcctctagggcaatggcagaacatgggggc

SEQ ID NO: 3237 - DNA, 200 bp, Kochia scoparia
gaaacagtttatttatacgctatgaattatgatcctggtaggctggcatcgttccactgtaatatgattctgatttcaatctatacaggctgatgtgattgaacgtctccgccttcaacataaaaatgatctatcaaaagttgttgatattgtcctatcacatcaggtaagcaggaaatttcaaataatacaaaataaaa

SEQ ID NO: 3238 - DNA, 200 bp, Kochia scoparia
ttttattttgtattatttgaaatttcctgcttacctgatgtgataggacaatatcaacaacttttgatagatcatttttatgttgaaggcggagacgttcaatcacatcagcctgtatagattgaaatcagaatcatattacagtggaacgatgccagcctaccaggatcataattcatagcgtataaataaactgtttc

SEQ ID NO: 3239 - DNA, 200 bp, Kochia scoparia
aaatttcaaataatacaaaataaaattttctgagttttctttttattttcttttcttttttttcccactttcccttgtactgtcttctagacttgtttactgtgtagtaataatggttttcagggtgttaagaataaaaataaattgatcctccggctcatggaacaactggtttactcaaatcctgccgcatatcggga

SEQ ID NO: 3240 - DNA, 200 bp, Kochia scoparia
tcccgatatgcggcaggatttgagtaaaccagttgttccatgagccggaggatcaatttatttttattcttaacaccctgaaaaccattattactacacagtaaacaagtctagaagacagtacaagggaaagtgggaaaaaaaagaaaagaaaataaaaagaaaactcagaaaattttattttgtattatttgaaattt

SEQ ID NO: 3241 - DNA, 200 bp, Kochia scoparia
actcaaatcctgccgcatatcgggataagcttaaacatttttcacaactgaaccataaaacatactctaaggttagagatgattcaactttttgcattattgtcacactacaacattcacaaaaaggtcattaagtttatacactaattaattccttcgctatatgcagttggctcgtaaggcaagtcaattgcttgaac

SEQ ID NO: 3242 - DNA, 200 bp, Kochia scoparia
gttcaagcaattgacttgccttacgagccaactgcatatagcgaaggaattaattagtgtataaacttaatgacctttttgtgaatgttgtagtgtgacaataatgcaaaaagttgaatcatctctaaccttagagtatgttttatggttcagttgtgaaaaatgtttaagcttatcccgatatgcggcaggatttgagt

SEQ ID NO: 3243 - DNA, 200 bp, Kochia scoparia
cgtaaggcaagtcaattgcttgaacaaacccagttgagtgaacttcgttctaatattgccagaaacctttccgagttagaaatgtttacagaagacggtgaaagcatggacgttacaaaaaggaaaagtgttattaatgaacgtatggatgctcttgttaatactccgcttgctgttgaagatgcccttgttggcttgtt

SEQ ID NO: 3244 - DNA, 200 bp, Kochia scoparia
aacaagccaacaagggcatcttcaacagcaagcggagtattaacaagagcatccatacgttcattaataacacttttcctttttgtaacgtccatgctttcaccgtcttctgtaaacatttctaactcggaaaggtttctggcaatattagaacgaagttcactcaactgggtttgttcaagcaattgacttgccttacg

SEQ ID NO: 3245 - DNA, 200 bp, Kochia scoparia
ttgaagatgcccttgttggcttgttcgatcacagcgatcatacattacaaaggcgggttgttgagacttatatccagaggctttatcaagtaatatctaagtttcaacattaaactttaacaatcatttgataatattatgtcatttaactctcttttttgtgggtaacctcttttctcagccttatcttgtaaagggaa

SEQ ID NO: 3246 - DNA, 200 bp, Kochia scoparia
ttccctttacaagataaggctgagaaaagaggttacccacaaaaaagagagttaaatgacataatattatcaaatgattgttaaagtttaatgttgaaacttagatattacttgataaagcctctggatataagtctcaacaacccgcctttgtaatgtatgatcgctgtgatcgaacaagccaacaagggcatcttcaa

SEQ ID NO: 3247 - DNA, 200 bp, Kochia scoparia
tctcagccttatcttgtaaagggaagtgtcaagatgcagtggcaccgatatggcctcattgcttcttgggagttcatggaggagcacattgaaagagcaaatgccgctaatgatttgtccatcaaccagcctcttgctgagaaactcattgagagaaaattgggagtcatggtcatcattaaatctcttcagtttttgcc

SEQ ID NO: 3248 - DNA, 200 bp, Kochia scoparia
ggcaaaaactgaagagatttaatgatgaccatgactcccaattttctctcaatgagtttctcagcaagaggctggttgatggacaaatcattagcggcatttgctctttcaatgtgctcctccatgaactcccaagaagcaatgaggccatatcggtgccactgcatcttgacacttccctttacaagataaggctgaga

SEQ ID NO: 3249 - DNA, 200 bp, Kochia scoparia
tcattaaatctcttcagtttttgccaagagtgattactgctgcattaaaagagaccacggataattcagatgaaatgattcccagaggttctttagattcaatcagtcacggaaataagttgcacattgcacttgtgggtgttaataaccagatgagctcgttgcaggataggtatagattctatccttgtagtttcagc

SEQ ID NO: 3250 - DNA, 200 bp, Kochia scoparia
gctgaaactacaaggatagaatctatacctatcctgcaacgagctcatctggttattaacacccacaagtgcaatgtgcaacttatttccgtgactgattgaatctaaagaacctctgggaatcatttcatctgaattatccgtggtctcttttaatgcagcagtaatcactcttggcaaaaactgaagagatttaatga

SEQ ID NO: 3251 - DNA, 200 bp, Kochia scoparia
tagattctatccttgtagtttcagcaagattttaaatgtggacattattggaccatccggtttttttgaagaaatatgctttgcttcaattatacagttgctcttaatattatccattccagccttttgcttaaccttttttgtctttgtggtttatgaaatttatttttatactattcagtggtgatgaagatcaagct

SEQ ID NO: 3252 - DNA, 200 bp, Kochia scoparia
agcttgatcttcatcaccactgaatagtataaaaataaatttcataaaccacaaagacaaaaaaggttaagcaaaaggctggaatggataatattaagagcaactgtataattgaagcaaagcatatttcttcaaaaaaaccggatggtccaataatgtccacatttaaaatcttgctgaaactacaaggatagaatcta

SEQ ID NO: 3253 - DNA, 200 bp, Kochia scoparia
attcagtggtgatgaagatcaagctaaagagagaattaataagttggcgaaaatcctgagagagaaagaagtgagctcagttcttcttaacagtggtgttggggtaattagttgcattatacagagaaatggaggaagaatcccaatgaggcattcattctattggtcagaagagaaacaatactttaatgaagagcctt

SEQ ID NO: 3254 - DNA, 200 bp, Kochia scoparia
aaggctcttcattaaagtattgtttctcttctgaccaatagaatgaatgcctcattgggattcttcctccatttctctgtataatgcaactaattaccccaacaccactgttaagaagaactgagctcacttctttctctctcaggattttcgccaacttattaattctctctttagcttgatcttcatcaccactgaat

SEQ ID NO: 3255 - DNA, 200 bp, Kochia scoparia
aaacaatactttaatgaagagcctttactacgtcatttggaacctcctctatcaatatatcttgaactggtaataaaattctgagcaagaagctgttgctttgtttgttcgttcttttcttgttttttaatatgggccaaatcattatctttaatatttttatcactatatgatatagttataaggtatttggctcacaa

SEQ ID NO: 3256 - DNA, 200 bp, Kochia scoparia
ttgtgagccaaataccttataactatatcatatagtgataaaaatattaaagataatgatttggcccatattaaaaaacaagaaaagaacgaacaaacaaagcaacagcttcttgctcagaattttattaccagttcaagatatattgatagaggaggttccaaatgacgtagtaaaggctcttcattaaagtattgttt

SEQ ID NO: 3257 - DNA, 200 bp, Kochia scoparia
tagttataaggtatttggctcacaattttcattatacaggacaagctcaaacactatgaaaatcccagatatactccttctcgggatcatcagtggcacctgtatactgtcatggacaagccatctattcgacgaatgtttttgaggacacttgtcagacagcccacctccgagtttagcggggttgaactagaaatgct

SEQ ID NO: 3258 - DNA, 200 bp, Kochia scoparia
agcatttctagttcaaccccgctaaactcggaggtgggctgtctgacaagtgtcctcaaaaacattcgtcgaatagatggcttgtccatgacagtatacaggtgccactgatgatcccgagaaggagtatatctgggattttcatagtgtttgagcttgtcctgtataatgaaaattgtgagccaaataccttataacta

SEQ ID NO: 3259 - DNA, 200 bp, Kochia scoparia
ttagcggggttgaactagaaatgcttaaaacacaaaggcctatctcctttacttcaagaaacatactgaggtctttaacaactgcaatggaagaattagaactcaatgcgcacaatgctaccttgaaacctgatcatgctcatatgtacctgtgcattgtaagagagcaacgaattcaagatcttgtcccatatcacagg

SEQ ID NO: 3260 - DNA, 200 bp, Kochia scoparia
cctgtgatatgggacaagatcttgaattcgttgctctcttacaatgcacaggtacatatgagcatgatcaggtttcaaggtagcattgtgcgcattgagttctaattcttccattgcagttgttaaagacctcagtatgtttcttgaagtaaaggagataggcctttgtgttttaagcatttctagttcaaccccgctaa

SEQ ID NO: 3261 - DNA, 200 bp, Kochia scoparia
tcaagatcttgtcccatatcacaggttctaattaatcatcttaattttctgtgtttcattcgtggtcattgatgcaacttatgccttaatagatattattttgacccattgatccagggaggtgaacattgatgatgaacaagaagagataactgttcagatatatttggaagagcttgcgcgtgaaatccacagttttg

SEQ ID NO: 3262 - DNA, 200 bp, Kochia scoparia
caaaactgtggatttcacgcgcaagctcttccaaatatatctgaacagttatctcttcttgttcatcatcaatgttcacctccctggatcaatgggtcaaaataatatctattaaggcataagttgcatcaatgaccacgaatgaaacacagaaaattaagatgattaattagaacctgtgatatgggacaagatcttga

SEQ ID NO: 3263 - DNA, 200 bp, Kochia scoparia
cttgcgcgtgaaatccacagttttgctggtgtgagaatgcataaactaaatgtatgtgagtgggaagtaaagctttgggtgtcatcttctggccaagccaatggttcatggagaatcattgttaataatgtgactggtcatacatgcactgtacatgtaagtttgaattttgattatttttcctataactttctgtacat

SEQ ID NO: 3264 - DNA, 200 bp, Kochia scoparia
atgtacagaaagttataggaaaaataatcaaaattcaaacttacatgtacagtgcatgtatgaccagtcacattattaacaatgattctccatgaaccattggcttggccagaagatgacacccaaagctttacttcccactcacatacatttagtttatgcattctcacaccagcaaaactgtggatttcacgcgcaag

SEQ ID NO: 3265 - DNA, 200 bp, Kochia scoparia
atttttcctataactttctgtacatcaaccatgtttagtgatttctttcaacactctgatatttatgccagtttttgtaagaattatagaaatacagtagcaatgttttgatagcccaggttctctctttctcccaaattaatctttgtgtcaatgcatgactttgccgcatcaatatcttaaataatttatgattataa

SEQ ID NO: 3266 - DNA, 200 bp, Kochia scoparia
ttataatcataaattatttaagatattgatgcggcaaagtcatgcattgacacaaagattaatttgggagaaagagagaacctgggctatcaaaacattgctactgtatttctataattcttacaaaaactggcataaatatcagagtgttgaaagaaatcactaaacatggttgatgtacagaaagttataggaaaaat

SEQ ID NO: 3267 - DNA, 200 bp, Kochia scoparia
tatcttaaataatttatgattataaactataagaatatgatactatgagaaattgaaaatatacatcgagagaaatctaaatacaccttccataacctttgatttattattttattttttaatggaaaaacaatgggcaaaggtgatacatgaatcatgtaaaacacaaactttgattttacatatgggatgaagggact

SEQ ID NO: 3268 - DNA, 200 bp, Kochia scoparia
agtcccttcatcccatatgtaaaatcaaagtttgtgttttacatgattcatgtatcacctttgcccattgtttttccattaaaaaataaaataataaatcaaaggttatggaaggtgtatttagatttctctcgatgtatattttcaatttctcatagtatcatattcttatagtttataatcataaattatttaagata

SEQ ID NO: 3269 - DNA, 200 bp, Kochia scoparia
attttacatatgggatgaagggactagtaatggtttgtatattggcactgacaaagaaaagtttattcatgattaatttacgtcttgtatacgtgtatcacataatgtcttctttagtttgatgaccttttttctactaatgttatgcaggtttaccgtgagttggaggataacaaccttcatgaaatgatctaccattc

SEQ ID NO: 3270 - DNA, 200 bp, Kochia scoparia
gaatggtagatcatttcatgaaggttgttatcctccaactcacggtaaacctgcataacattagtagaaaaaaggtcatcaaactaaagaagacattatgtgatacacgtatacaagacgtaaattaatcatgaataaacttttctttgtcagtgccaatatacaaaccattactagtcccttcatcccatatgtaaaat

SEQ ID NO: 3271 - DNA, 200 bp, Kochia scoparia
accttcatgaaatgatctaccattcaatatctgttcaaggtcctctccatggaataccagtgaatgcaccctatcaaccacttggagtcattgcccgtaaaagacttcaggccaggaaaaatagcacaacctattgttatgacttcccactggtaagaaatattaaactccactataccccaatactacaaaagcagaat

SEQ ID NO: 3272 - DNA, 200 bp, Kochia scoparia
attctgcttttgtagtattggggtatagtggagtttaatatttcttaccagtgggaagtcataacaataggttgtgctatttttcctggcctgaagtcttttacgggcaatgactccaagtggttgatagggtgcattcactggtattccatggagaggaccttgaacagatattgaatggtagatcatttcatgaaggt

SEQ ID NO: 3273 - DNA, 200 bp, Kochia scoparia
taccccaatactacaaaagcagaattttactatattaggtttccttccctcccgaatttttttaaaaaataagagttaatacatgacttgcattcgagtgtaactatgttcttattaacgctcaactagtaatgcaatgggaatataaatctaaattctaagagggaggtggggttcagtaactgtgggactaggttgca

SEQ ID NO: 3274 - DNA, 200 bp, Kochia scoparia
tgcaacctagtcccacagttactgaaccccacctccctcttagaatttagatttatattcccattgcattactagttgagcgttaataagaacatagttacactcgaatgcaagtcatgtattaactcttattttttaaaaaaattcgggagggaaggaaacctaatatagtaaaattctgcttttgtagtattggggta

SEQ ID NO: 3275 - DNA, 200 bp, Kochia scoparia
tcagtaactgtgggactaggttgcaccgatacgggtacggggacatatacgggtacgggaacggggacgggaaacgacaattttaaaaattcttgggtacggggacggatttgggaacgacaatttattaaatataaatttttattttaaaaaaaaatgagcattgtgatcattttaataaaaaaaatgcaacaaaataa

SEQ ID NO: 3276 - DNA, 200 bp, Kochia scoparia
ttattttgttgcattttttttattaaaatgatcacaatgctcatttttttttaaaataaaaatttatatttaataaattgtcgttcccaaatccgtccccgtacccaagaatttttaaaattgtcgtttcccgtccccgttcccgtacccgtatatgtccccgtacccgtatcggtgcaacctagtcccacagttactga

SEQ ID NO: 3277 - DNA, 200 bp, Kochia scoparia
taataaaaaaaatgcaacaaaataaaaatcatagttaatacaaataatttagtccaaagtaaaaggcaagtagacaacatttaattttttttaaacataaccagaaaacataaatttaatagggtaaataaaaaatggtgaaatccaaaaaattaaataaatgacacaaataagcacacattcacaaccacacatttaca

SEQ ID NO: 3278 - DNA, 200 bp, Kochia scoparia
tgtaaatgtgtggttgtgaatgtgtgcttatttgtgtcatttatttaattttttggatttcaccattttttatttaccctattaaatttatgttttctggttatgtttaaaaaaaattaaatgttgtctacttgccttttactttggactaaattatttgtattaactatgatttttattttgttgcattttttttatta

SEQ ID NO: 3279 - DNA, 200 bp, Kochia scoparia
acacattcacaaccacacatttacaaatcacaaattcacaaccacataaaatgaattaaagtggaatagtttactgacatgctttggaagacaatagaaaaagtgaaagagaagattagaagaagaaagtgagatttaagaagccacgaagtgaagcctagcgccatagtggaatagtcaagcctcaacatcgtcgaata

SEQ ID NO: 3280 - DNA, 200 bp, Kochia scoparia
tattcgacgatgttgaggcttgactattccactatggcgctaggcttcacttcgtggcttcttaaatctcactttcttcttctaatcttctctttcactttttctattgtcttccaaagcatgtcagtaaactattccactttaattcattttatgtggttgtgaatttgtgatttgtaaatgtgtggttgtgaatgtgt

SEQ ID NO: 3281 - DNA, 200 bp, Kochia scoparia
agtcaagcctcaacatcgtcgaatagtgtagccttgcgccatcgccattgagagtgagtggcagaaccaccgtttgccgtcaccgtggtgtaatgcatcgtcgtcgagaggaagagagagagaccctagaatttgaaattggtttgttttttgttgtgccaagtggtttattcaacattctattgtaattttgttgtttt

SEQ ID NO: 3282 - DNA, 200 bp, Kochia scoparia
aaaacaacaaaattacaatagaatgttgaataaaccacttggcacaacaaaaaacaaaccaatttcaaattctagggtctctctctcttcctctcgacgacgatgcattacaccacggtgacggcaaacggtggttctgccactcactctcaatggcgatggcgcaaggctacactattcgacgatgttgaggcttgact

SEQ ID NO: 3283 - DNA, 200 bp, Kochia scoparia
cattctattgtaattttgttgttttataaactaaaagaaagctgaaatcacccttggggacgcatgtgaagcttaccgccatccccggagacgtccccaaaagtcaacgccgttcccggaagtcaatggcgtcccgaggacgtccccaagccgtccccggcgcgtttccgtccccgttctgtccccggtacgggggacgc

SEQ ID NO: 3284 - DNA, 200 bp, Kochia scoparia
gcgtcccccgtaccggggacagaacggggacggaaacgcgccggggacggcttggggacgtcctcgggacgccattgacttccgggaacggcgttgacttttggggacgtctccggggatggcggtaagcttcacatgcgtccccaagggtgatttcagctttcttttagtttataaaacaacaaaattacaatagaatg

SEQ ID NO: 3285 - DNA, 200 bp, Kochia scoparia
gttctgtccccggtacgggggacgctggctatgtggcgtccccgtgcaacatagctgtgggaccttgtaaaggtttaaagtttggtggagatgctgggtttataattagtttaggacgaaactgccaagttttctattgtatgtaatttattggttatgaaagtaaaaaatcgtgattgttatgcaaatgattgtaccta

SEQ ID NO: 3286 - DNA, 200 bp, Kochia scoparia
taggtacaatcatttgcataacaatcacgattttttactttcataaccaataaattacatacaatagaaaacttggcagtttcgtcctaaactaattataaacccagcatctccaccaaactttaaacctttacaaggtcccacagctatgttgcacggggacgccacatagccagcgtcccccgtaccggggacagaac

SEQ ID NO: 3287 - DNA, 200 bp, Kochia scoparia
attgttatgcaaatgattgtacctatagtgattgtgtgacaatgttgtcaaatgtataagcattgcaatttttttgagataagggaaccgtaaataaaaatacaacgcatggcttggatgttaccgtcattaccgatttttgtcctatgtagtggtatctcaaatttttatatttcactttggagcgatcaacttgcttt

SEQ ID NO: 3288 - DNA, 200 bp, Kochia scoparia
aaagcaagttgatcgctccaaagtgaaatataaaaatttgagataccactacataggacaaaaatcggtaatgacggtaacatccaagccatgcgttgtatttttatttacggttcccttatctcaaaaaaattgcaatgcttatacatttgacaacattgtcacacaatcactataggtacaatcatttgcataacaat

SEQ ID NO: 3289 - DNA, 200 bp, Kochia scoparia
cactttggagcgatcaacttgctttaggtgctagtatttatctgtttttctatgggaaaattgacttgtaattgttgggaatgtttttcttaggctttctctactgccttggagcaatcatgggcatcccaacctccgctgctgaagaaacccacaaacaaaaaagttttgaaagtctcagagctagtatttgctgatgc

SEQ ID NO: 3290 - DNA, 200 bp, Kochia scoparia
gcatcagcaaatactagctctgagactttcaaaacttttttgtttgtgggtttcttcagcagcggaggttgggatgcccatgattgctccaaggcagtagagaaagcctaagaaaaacattcccaacaattacaagtcaattttcccatagaaaaacagataaatactagcacctaaagcaagttgatcgctccaaagtg

SEQ ID NO: 3291 - DNA, 200 bp, Kochia scoparia
tctcagagctagtatttgctgatgcaaatggcacctggggaacacaagttgtcccaacagaccgtgaacctggtcttaataatattggcatggtggcctggtccatggagatgtcaactcctgaatttcctgatggaaggaccatattggttgtagcaaatgatatcaccttcatggctggatcatttgggccaaaagaa

SEQ ID NO: 3292 - DNA, 200 bp, Kochia scoparia
ttcttttggcccaaatgatccagccatgaaggtgatatcatttgctacaaccaatatggtccttccatcaggaaattcaggagttgacatctccatggaccaggccaccatgccaatattattaagaccaggttcacggtctgttgggacaacttgtgttccccaggtgccatttgcatcagcaaatactagctctgaga

SEQ ID NO: 3293 - DNA, 200 bp, Kochia scoparia
ggctggatcatttgggccaaaagaagatgctctcttccgggcagttacagatcttgcttgttccaaaaaaattcctctgatttacctggctgctaattctggtgcccgactgggtgttgctgaagaggtaagagcgtgctttaaaattggttggtctgatgaactgaaccctgaacgggggttccagtatatctacttga

SEQ ID NO: 3294 - DNA, 200 bp, Kochia scoparia
tcaagtagatatactggaacccccgttcagggttcagttcatcagaccaaccaattttaaagcacgctcttacctcttcagcaacacccagtcgggcaccagaattagcagccaggtaaatcagaggaatttttttggaacaagcaagatctgtaactgcccggaagagagcatcttcttttggcccaaatgatccagcc

SEQ ID NO: 3295 - DNA, 200 bp, Kochia scoparia
cgggggttccagtatatctacttgactcctgaagattatggtcgtatagggtcagcagttatagcccatgagttagaactccaaaatggagagactcggtgggttatagacactattgtagggaaggaggatgggttaggtgttgagaacttatccggaagtgcggctatagctggtgcctattcaagggcatacaaaga

SEQ ID NO: 3296 - DNA, 200 bp, Kochia scoparia
tctttgtatgcccttgaataggcaccagctatagccgcacttccggataagttctcaacacctaacccatcctccttccctacaatagtgtctataacccaccgagtctctccattttggagttctaactcatgggctataactgctgaccctatacgaccataatcttcaggagtcaagtagatatactggaacccccg

SEQ ID NO: 3297 - DNA, 200 bp, Kochia scoparia
gtgcctattcaagggcatacaaagaaacttttacactaacttttgtaacaggaagaacagttggtattggtgcctatcttgctcgccttgggatgcgttgtatccaaaggcttgatcagcccattattctgacaggcttttcaacattaaataaacttcttggtcgtgaggtttacagctcacaaatgcaacttggtggg

SEQ ID NO: 3298 - DNA, 200 bp, Kochia scoparia
cccaccaagttgcatttgtgagctgtaaacctcacgaccaagaagtttatttaatgttgaaaagcctgtcagaataatgggctgatcaagcctttggatacaacgcatcccaaggcgagcaagataggcaccaataccaactgttcttcctgttacaaaagttagtgtaaaagtttctttgtatgcccttgaataggcac

SEQ ID NO: 3299 - DNA, 200 bp, Kochia scoparia
cagctcacaaatgcaacttggtgggcccaagattatgggtacaaacggtgttgttcatttaacagtttcagatgaccttgaaggcatttcatctattatcaaatggcttagctatgttccatcctattcaggaggtgaacttcctatttcacgttctttagatcctccagaaagacaggttgagtatttgcctgacaatt

SEQ ID NO: 3300 - DNA, 200 bp, Kochia scoparia
aattgtcaggcaaatactcaacctgtctttctggaggatctaaagaacgtgaaataggaagttcacctcctgaataggatggaacatagctaagccatttgataatagatgaaatgccttcaaggtcatctgaaactgttaaatgaacaacaccgtttgtacccataatcttgggcccaccaagttgcatttgtgagctg

SEQ ID NO: 3301 - DNA, 200 bp, Kochia scoparia
caggttgagtatttgcctgacaattcttgcgatccccgttctgccatatctggtacacttgactctgatggtaattggcttggtggaattttcgacaaagatagttttgttgaaaccctacaaggctgggcaaggacagttatcactggccgcgccaaacttggtggaattccagttgggatagttgctgttgagacaca

SEQ ID NO: 3302 - DNA, 200 bp, Kochia scoparia
tgtgtctcaacagcaactatcccaactggaattccaccaagtttggcgcggccagtgataactgtccttgcccagccttgtagggtttcaacaaaactatctttgtcgaaaattccaccaagccaattaccatcagagtcaagtgtaccagatatggcagaacggggatcgcaagaattgtcaggcaaatactcaacctg

SEQ ID NO: 3303 - DNA, 200 bp, Kochia scoparia
ttgggatagttgctgttgagacacaaactgtgatgcaagctatcccagctgatcctggtcagcttgattctcatgagcgagttgtctcacaagctggacaagtatggtttccggattctgcaactaagacagcacaagctttgatggattttaacagggaaggacttccacttttcattctagctaactggagagggttc

SEQ ID NO: 3304 - DNA, 200 bp, Kochia scoparia
gaaccctctccagttagctagaatgaaaagtggaagtccttccctgttaaaatccatcaaagcttgtgctgtcttagttgcagaatccggaaaccatacttgtccagcttgtgagacaactcgctcatgagaatcaagctgaccaggatcagctgggatagcttgcatcacagtttgtgtctcaacagcaactatcccaa

SEQ ID NO: 3305 - DNA, 200 bp, Kochia scoparia
cattctagctaactggagagggttctctggagggcaaagggatctctttgaagggattcttcaggcaggttccacaattgtcgagaaccttaggacttataatcaacctatttttgtttatatccccatgatgggtgaacttcgtggtggcgcgtgggttgtcgtagacagtcgaatcaattcggaccagattgagatgt

SEQ ID NO: 3306 - DNA, 200 bp, Kochia scoparia
acatctcaatctggtccgaattgattcgactgtctacgacaacccacgcgccaccacgaagttcacccatcatggggatataaacaaaaataggttgattataagtcctaaggttctcgacaattgtggaacctgcctgaagaatcccttcaaagagatccctttgccctccagagaaccctctccagttagctagaatg

SEQ ID NO: 3307 - DNA, 200 bp, Kochia scoparia
atcaattcggaccagattgagatgtatgctgaccagacagcaaaaggaaatgttcttgagccagaaggaatgattgaggtgaagtttagaaccaaggaattaattgaatgtatggaaaggcttgatcaacatcttatcaatcttaatgcaaaacttgttgaagccaaaaactccaattcatcggatgacatcaaacccct

SEQ ID NO: 3308 - DNA, 200 bp, Kochia scoparia
aggggtttgatgtcatccgatgaattggagtttttggcttcaacaagttttgcattaagattgataagatgttgatcaagcctttccatacattcaattaattccttggttctaaacttcacctcaatcattccttctggctcaagaacatttccttttgctgtctggtcagcatacatctcaatctggtccgaattgat

SEQ ID NO: 3309 - DNA, 200 bp, Kochia scoparia
attcatcggatgacatcaaacccctcaaacagcagatagaagctcggcagaagcaacttttgcctctatatactcaaatagccacaaaatttgctgacttgcatgatagtccttatagaatggctgcgaaaggagttgtcaaggaagtcctggattggagcaattctcgctcattcttccacaaaagactgtacaggaga

SEQ ID NO: 3310 - DNA, 200 bp, Kochia scoparia
tctcctgtacagtcttttgtggaagaatgagcgagaattgctccaatccaggacttccttgacaactcctttcgcagccattctataaggactatcatgcaagtcagcaaattttgtggctatttgagtatatagaggcaaaagttgcttctgccgagcttctatctgctgtttgaggggtttgatgtcatccgatgaat

SEQ ID NO: 3311 - DNA, 200 bp, Kochia scoparia
cttccacaaaagactgtacaggagagtaatggaggaatcacttgtcaagactgtccgagatgctgctggtgaagcaatgacccacaagtctgccttggagttgatcaagcaatggcttgctgagtctgccatggatagtactactagagcgggagctgatgcttgggctgacgatgaagctttcttcaggtggaaagaaa

SEQ ID NO: 3312 - DNA, 200 bp, Kochia scoparia
tttctttccacctgaagaaagcttcatcgtcagcccaagcatcagctcccgctctagtagtactatccatggcagactcagcaagccattgcttgatcaactccaaggcagacttgtgggtcattgcttcaccagcagcatctcggacagtcttgacaagtgattcctccattactctcctgtacagtcttttgtggaag

SEQ ID NO: 3313 - DNA, 200 bp, Kochia scoparia
gaagctttcttcaggtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtatctctaaggttcctccacacacacacacaccccac

SEQ ID NO: 3314 - DNA, 200 bp, Kochia scoparia
gtggggtgtgtgtgtgtgtggaggaaccttagagataccttctgaagtagggcaacaagaccctgacgaagctgaagagctctcagatcagaagctgagttgtcaatatttgaaagctgatgcaatactttctgtatgcgtaactcaattagcttttcttcataattagcaggattttctttccacctgaagaaagcttc

SEQ ID NO: 3315 - DNA, 200 bp, Kochia scoparia
tcctccacacacacacacaccccacccaccaaaaaaaacacacacacacacattcacaagaaaagtagaattgctagtgaaataacttcatcgtgttcaatgcaggtgaattcctcaagccgagcaaatctagtagagaaactcgagaaagtgctcaattgatttggtaatgatcctgcagaaaaacctcttggtatatg

SEQ ID NO: 3316 - DNA, 200 bp, Kochia scoparia
catataccaagaggtttttctgcaggatcattaccaaatcaattgagcactttctcgagtttctctactagatttgctcggcttgaggaattcacctgcattgaacacgatgaagttatttcactagcaattctacttttcttgtgaatgtgtgtgtgtgtgttttttttggtgggtggggtgtgtgtgtgtgtggagga

SEQ ID NO: 3317 - DNA, 200 bp, Kochia scoparia
ctgcagaaaaacctcttggtatatggtggtatgcaaatgccatatctgaaagattgattaggcaagttgagacagagacaggcacagttgtaataatgggatctatcaaaccagaagacgttataactaagctcaaagatgatggtgattttgaccgtcttcgtctcaaaatcattcgtaagctcaaacaaaacgtattt

SEQ ID NO: 3318 - DNA, 200 bp, Kochia scoparia
aaatacgttttgtttgagcttacgaatgattttgagacgaagacggtcaaaatcaccatcatctttgagcttagttataacgtcttctggtttgatagatcccattattacaactgtgcctgtctctgtctcaacttgcctaatcaatctttcagatatggcatttgcataccaccatataccaagaggtttttctgcag

SEQ ID NO: 3319 - DNA, 200 bp, Kochia scoparia
tcgtaagctcaaacaaaacgtatttctttctccttttcatcttctactgtatattaaatggtttaaaatttgatcttgattaatgggtaatctttataattttatcttttttattataatacaagaatgatatgcatatttttattttgttattaattaccaaatgcacttcagtttacattgccggttttgaagttttg

SEQ ID NO: 3320 - DNA, 200 bp, Kochia scoparia
caaaacttcaaaaccggcaatgtaaactgaagtgcatttggtaattaataacaaaataaaaatatgcatatcattcttgtattataataaaaaagataaaattataaagattacccattaatcaagatcaaattttaaaccatttaatatacagtagaagatgaaaaggagaaagaaatacgttttgtttgagcttacga

SEQ ID NO: 3321 - DNA, 200 bp, Kochia scoparia
ttacattgccggttttgaagttttggaagcagaattggggttagaatgctagatattattgcttgttgatcatttattcagttacttacattgtttggttgaaatcggaattaaaagagcacaaattgtatggtttctaactcgacttcacaataagagtatagatgctcactgttgtgttgtgtgttttgtttttgtta

SEQ ID NO: 3322 - DNA, 200 bp, Kochia scoparia
taacaaaaacaaaacacacaacacaacagtgagcatctatactcttattgtgaagtcgagttagaaaccatacaatttgtgctcttttaattccgatttcaaccaaacaatgtaagtaactgaataaatgatcaacaagcaataatatctagcattctaaccccaattctgcttccaaaacttcaaaaccggcaatgtaa

SEQ ID NO: 3323 - DNA, 200 bp, Kochia scoparia
tgtgttgtgtgttttgtttttgttaagaaatattggttttgattgatgatgctccaagcctcgagtgagcgtgttgatgaaatagagtactgaattaaaggttatcattttatcgaatgtcagattaattgttaattgttgctcggagtcggagtttaaatgagaatcattttatcgaatgtcttaagttatcagggcag

SEQ ID NO: 3324 - DNA, 200 bp, Kochia scoparia
ctgccctgataacttaagacattcgataaaatgattctcatttaaactccgactccgagcaacaattaacaattaatctgacattcgataaaatgataacctttaattcagtactctatttcatcaacacgctcactcgaggcttggagcatcatcaatcaaaaccaatatttcttaacaaaaacaaaacacacaacaca

SEQ ID NO: 3325 - DNA, 200 bp, Kochia scoparia
cgaatgtcttaagttatcagggcagatattttttttctagtgggtatggactcttgagcctcttttttctgtatcaaactgtcctgttggttgttcaaattatgcaaatcatgaagagattactttggtctcaggtttgcttcgccatccttcccaatgaatcgtcaggattcattttcaattaaatcttatgtattcac

SEQ ID NO: 3326 - DNA, 200 bp, Kochia scoparia
gtgaatacataagatttaattgaaaatgaatcctgacgattcattgggaaggatggcgaagcaaacctgagaccaaagtaatctcttcatgatttgcataatttgaacaaccaacaggacagtttgatacagaaaaaagaggctcaagagtccatacccactagaaaaaaaatatctgccctgataacttaagacattcg

SEQ ID NO: 3327 - DNA, 200 bp, Kochia scoparia
tttcaattaaatcttatgtattcacgggttccttcgtcccggtcgcttcttagttaatgttctagcccggagccttgttgttggatggtttgatctactatagagttcattttctgacttgtttggcatttgttaatgggcattgatacgagttgtttaccgtattaaattaattatttataaaatttatcttagtcgtt

SEQ ID NO: 3328 - DNA, 200 bp, Kochia scoparia
aacgactaagataaattttataaataattaatttaatacggtaaacaactcgtatcaatgcccattaacaaatgccaaacaagtcagaaaatgaactctatagtagatcaaaccatccaacaacaaggctccgggctagaacattaactaagaagcgaccgggacgaaggaacccgtgaatacataagatttaattgaaa

SEQ ID NO: 3329 - DNA, 200 bp, Kochia scoparia
atttataaaatttatcttagtcgttcaaaaatatatacaagtaatttaaaattcaatctaaagtgaagtataagtacatatacacataatatttacgctatttacagaattatactaataatcgaattaaaataagtcaattagagtagtaaaggaattaacaaggtatttaactaaaacaattgatgagtaagaagaac

SEQ ID NO: 3330 - DNA, 200 bp, Kochia scoparia
gttcttcttactcatcaattgttttagttaaataccttgttaattcctttactactctaattgacttattttaattcgattattagtataattctgtaaatagcgtaaatattatgtgtatatgtacttatacttcactttagattgaattttaaattacttgtatatatttttgaacgactaagataaattttataaat

SEQ ID NO: 3331 - DNA, 200 bp, Kochia scoparia
aaaacaattgatgagtaagaagaactgatgaatttgtactcaagaacacccaaacgatactccgcttcaacctcacgactcgatgtcattctcgttcgaccttgaattcaagactaagctacctttcaattgttgtctcctcttccaattgctccaatcgaaaatcctatcaaaactcttactctcaattgctctcaaaa

SEQ ID NO: 3332 - DNA, 200 bp, Kochia scoparia
ttttgagagcaattgagagtaagagttttgataggattttcgattggagcaattggaagaggagacaacaattgaaaggtagcttagtcttgaattcaaggtcgaacgagaatgacatcgagtcgtgaggttgaagcggagtatcgtttgggtgttcttgagtacaaattcatcagttcttcttactcatcaattgtttt

SEQ ID NO: 3333 - DNA, 200 bp, Kochia scoparia
atgggcgagtccgattcctggacaccaatgtcgaatttgacacttcatccaagtccaaatgatattgattcaacatattggtgtaacagttataggaaaagtgggcgtattttttgccaagggcagggcggaatgttatctagggaagacccaaataaggcaacttcggagggaaaaattgattaccccaacagaacaac

SEQ ID NO: 3334 - DNA, 200 bp, Kochia scoparia
gttgttctgttggggtaatcaatttttccctccgaagttgccttatttgggtcttccctagataacattccgccctgcccttggcaaaaaatacgcccacttttcctataactgttacaccaatatgttgaatcaatatcatttggacttggatgaagtgtcaaattcgacattggtgtccaggaatcggactcgcccat

SEQ ID NO: 3335 - DNA, 200 bp, Kochia scoparia
aaattgattaccccaacagaacaactcttttgaggaaatctgctacattacctgttgatgaattacctgttgatgaattttgttatgctcttggagggaaaagaccgattcgtagtattttgattgcaaacaatggaatggcagctgttaaatttataagaagcattcggacatgggcttatgagaccttcggaacagag

SEQ ID NO: 3336 - DNA, 200 bp, Kochia scoparia
ctctgttccgaaggtctcataagcccatgtccgaatgcttcttataaatttaacagctgccattccattgtttgcaatcaaaatactacgaatcggtcttttccctccaagagcataacaaaattcatcaacaggtaattcatcaacaggtaatgtagcagatttcctcaaaagagttgttctgttggggtaatcaattt

SEQ ID NO: 3337 - DNA, 200 bp, Kochia scoparia
ggcttatgagaccttcggaacagagaaggctattgtattagtagcaatagctactccagaagacatgagaatcaacgctgaacacattcgaatggctgaccagtttgttgaggttcctggtgggactaacaacaacaactatgccaatgtgcagctcattgttgagatggcagagatgacacgtgttgatgctgtttggc

SEQ ID NO: 3338 - DNA, 200 bp, Kochia scoparia
gccaaacagcatcaacacgtgtcatctctgccatctcaacaatgagctgcacattggcatagttgttgttgttagtcccaccaggaacctcaacaaactggtcagccattcgaatgtgttcagcgttgattctcatgtcttctggagtagctattgctactaatacaatagccttctctgttccgaaggtctcataagcc

SEQ ID NO: 3339 - DNA, 200 bp, Kochia scoparia
atgacacgtgttgatgctgtttggccaggctggggacatgcatcggagaaccctgagcttccagatgcactaaacgcgaaggggattgaatttctagggcctccagctaaatctatggctgctcttggagacaaaattggttcatcattgattgctcaggccgcagatgttccaactcttccatggagtggctctcatgt

SEQ ID NO: 3340 - DNA, 200 bp, Kochia scoparia
acatgagagccactccatggaagagttggaacatctgcggcctgagcaatcaatgatgaaccaattttgtctccaagagcagccatagatttagctggaggccctagaaattcaatccccttcgcgtttagtgcatctggaagctcagggttctccgatgcatgtccccagcctggccaaacagcatcaacacgtgtcat

SEQ ID NO: 3341 - DNA, 200 bp, Kochia scoparia
ctcttccatggagtggctctcatgtgaaagctcctgctgagagttgccttgattctattcctgatgacatatacaaggcagcctgtgtttttaccacagaggaagcagttgctagttgtcaggttgtcggttatccagctatgattaaagcatcttggggtggtggagggaaaggaataagaaaggtgcataatgatgat

SEQ ID NO: 3342 - DNA, 200 bp, Kochia scoparia
atcatcattatgcacctttcttattcctttccctccaccaccccaagatgctttaatcatagctggataaccgacaacctgacaactagcaactgcttcctctgtggtaaaaacacaggctgccttgtatatgtcatcaggaatagaatcaaggcaactctcagcaggagctttcacatgagagccactccatggaagag

SEQ ID NO: 3343 - DNA, 200 bp, Kochia scoparia
aataagaaaggtgcataatgatgatgaagtaagggcattgttcaagcaagtgcagggcgaagttcctggctctcccatatttataatgaaggtggcttcacagagtcgacacttagaagtgcagttaatttgtgatcaatatggcaatgtagcagcattacatagccgtgattgcagtgtccaaaggcggcaccagaaga

SEQ ID NO: 3344 - DNA, 200 bp, Kochia scoparia
tcttctggtgccgcctttggacactgcaatcacggctatgtaatgctgctacattgccatattgatcacaaattaactgcacttctaagtgtcgactctgtgaagccaccttcattataaatatgggagagccaggaacttcgccctgcacttgcttgaacaatgcccttacttcatcatcattatgcacctttcttatt

SEQ ID NO: 3345 - DNA, 200 bp, Kochia scoparia
agtgtccaaaggcggcaccagaagattattgaagagggtccaataaatgtagctccccaagaaactgtgataaaacttgagcaggcagccagaaggttagccaaatatgtgaattttgttggagcagcaactgtagaatatctatacagcatggaaactggcgagttttatttcctcgagctaaaccctcggctacaggt

SEQ ID NO: 3346 - DNA, 200 bp, Kochia scoparia
acctgtagccgagggtttagctcgaggaaataaaactcgccagtttccatgctgtatagatattctacagttgctgctccaacaaaattcacatatttggctaaccttctggctgcctgctcaagttttatcacagtttcttggggagctacatttattggaccctcttcaataatcttctggtgccgcctttggacact

SEQ ID NO: 3347 - DNA, 200 bp, Kochia scoparia
tcgagctaaaccctcggctacaggtggagcacccagtaactgaatggattgctggaattaaccttccagctgctcaggttgcagttggcatgggtattcccctctggcaaattccagaaattcggcgattctatggtaaggaacatggtgggggttatgatgcttggagaagaacatcaattgctgcgactgcttttaat

SEQ ID NO: 3348 - DNA, 200 bp, Kochia scoparia
attaaaagcagtcgcagcaattgatgttcttctccaagcatcataacccccaccatgttccttaccatagaatcgccgaatttctggaatttgccagaggggaatacccatgccaactgcaacctgagcagctggaaggttaattccagcaatccattcagttactgggtgctccacctgtagccgagggtttagctcga

SEQ ID NO: 3349 - DNA, 200 bp, Kochia scoparia
atcaattgctgcgactgcttttaattttgacaaggcacaatctgtgaaaccgaaaggtcactgtattgccgtacgtgtgacaagtgaggaccctgatgatggattcaagcccactagtgggaaagtacaggagttgattttcaaaagtaaaccaaatatgtgggcctatttctctataaagtctgggggaggcattcatg

SEQ ID NO: 3350 - DNA, 200 bp, Kochia scoparia
catgaatgcctcccccagactttatagagaaataggcccacatatttggtttacttttgaaaatcaactcctgtactttcccactagtgggcttgaatccatcatcagggtcctcacttgtcacacgtacggcaatacagtgacctttcggtttcacagattgtgccttgtcaaaattaaaagcagtcgcagcaattgat

SEQ ID NO: 3351 - DNA, 200 bp, Kochia scoparia
ataaagtctgggggaggcattcatgagttctcagattctcaatttggtcatgtctttgcatttggtgaatcaagagggttggccatagcaaatatggttcttggcttgaaagaaattcaaattcgtggagaaattcgcactaatgttgattataccattgatcttttaaactcttcggattacagagataataaaattca

SEQ ID NO: 3352 - DNA, 200 bp, Kochia scoparia
tgaattttattatctctgtaatccgaagagtttaaaagatcaatggtataatcaacattagtgcgaatttctccacgaatttgaatttctttcaagccaagaaccatatttgctatggccaaccctcttgattcaccaaatgcaaagacatgaccaaattgagaatctgagaactcatgaatgcctcccccagactttat

SEQ ID NO: 3353 - DNA, 200 bp, Kochia scoparia
cggattacagagataataaaattcatacaggttggttagatagcagaattgcaatgagagtgaaagcggaaagacccccctggttcatctctgttgtgggaggagcactctacaaagcttttgctagtagtgcagctacagtttcagaatatgttggctatcttgagaaaggtcaaattcctccaaaggtaattcaagca

SEQ ID NO: 3354 - DNA, 200 bp, Kochia scoparia
tgcttgaattacctttggaggaatttgacctttctcaagatagccaacatattctgaaactgtagctgcactactagcaaaagctttgtagagtgctcctcccacaacagagatgaaccaggggggtctttccgctttcactctcattgcaattctgctatctaaccaacctgtatgaattttattatctctgtaatccg

SEQ ID NO: 3355 - DNA, 200 bp, Kochia scoparia
aattcctccaaaggtaattcaagcaccagatgctgttgagcatatatcacttgtccactctgaagtttctctgaatattgaggggagcaagtacactattaaagtggtgaggggcggtccaggaaactacagattgagattgaatgagtctgagattgaggctgaaatacatccattaagagatgggggtcttttgatgc

SEQ ID NO: 3356 - DNA, 200 bp, Kochia scoparia
gcatcaaaagacccccatctcttaatggatgtatttcagcctcaatctcagactcattcaatctcaatctgtagtttcctggaccgcccctcaccactttaatagtgtacttgctcccctcaatattcagagaaacttcagagtggacaagtgatatatgctcaacagcatctggtgcttgaattacctttggaggaatt

SEQ ID NO: 3357 - DNA, 200 bp, Kochia scoparia
ttaagagatgggggtcttttgatgcaattggatgggaaaagtcacgtgatatatgctcaggaagaggcagcaggaactcgccttcttattgatggacgaacgtgtttgcttcagaatgatcatgatccttcaaagttaattgtggaaacaccttgtaagctactgcggtatctggttccagatgatagtcatgttgatcc

SEQ ID NO: 3358 - DNA, 200 bp, Kochia scoparia
ggatcaacatgactatcatctggaaccagataccgcagtagcttacaaggtgtttccacaattaactttgaaggatcatgatcattctgaagcaaacacgttcgtccatcaataagaaggcgagttcctgctgcctcttcctgagcatatatcacgtgacttttcccatccaattgcatcaaaagacccccatctcttaa

SEQ ID NO: 3359 - DNA, 200 bp, Kochia scoparia
ttccagatgatagtcatgttgatccagatactccttttgctgaagttgaggttatgaagatgtgtatgcctttgctttcccctgcatctggtaaaataagatttaagatgtccgaaggacaacccatgcaggctggcgaactcatagcaaaacttgagttggatgatccttcagctgtaagaaaagctgaaccgttccgt

SEQ ID NO: 3360 - DNA, 200 bp, Kochia scoparia
acggaacggttcagcttttcttacagctgaaggatcatccaactcaagttttgctatgagttcgccagcctgcatgggttgtccttcggacatcttaaatcttattttaccagatgcaggggaaagcaaaggcatacacatcttcataacctcaacttcagcaaaaggagtatctggatcaacatgactatcatctggaa

SEQ ID NO: 3361 - DNA, 200 bp, Kochia scoparia
tgtaagaaaagctgaaccgttccgtggtagttttccaaccttgcatccgccaactgctatctcagaaaaggttcatcaaaaatttgttgcaagtttgaatgcagcccagatgattcttgctggttttgaacacaacatagatgaagttgtccagagtttgttgaggtgccttgatagtcctgaacttcctttcttgcaat

SEQ ID NO: 3362 - DNA, 200 bp, Kochia scoparia
attgcaagaaaggaagttcaggactatcaaggcacctcaacaaactctggacaacttcatctatgttgtgttcaaaaccagcaagaatcatctgggctgcattcaaacttgcaacaaatttttgatgaaccttttctgagatagcagttggcggatgcaaggttggaaaactaccacggaacggttcagcttttcttaca

SEQ ID NO: 3363 - DNA, 200 bp, Kochia scoparia
agtcctgaacttcctttcttgcaatggcaagaatgcttgtctgttctagcaacacggcttcccaaagatctgagaactgaattggaatcaaagtgtcgaaaattcacaggaattacgaattctcataacattgaatttcctgctatggtgtttaaaggtgttcttgaggcccatttgaattcatgccctgaaaaggagag

SEQ ID NO: 3364 - DNA, 200 bp, Kochia scoparia
ctctccttttcagggcatgaattcaaatgggcctcaagaacacctttaaacaccatagcaggaaattcaatgttatgagaattcgtaattcctgtgaattttcgacactttgattccaattcagttctcagatctttgggaagccgtgttgctagaacagacaagcattcttgccattgcaagaaaggaagttcaggact

SEQ ID NO: 3365 - DNA, 200 bp, Kochia scoparia
tgaattcatgccctgaaaaggagagaggagctcaagagcggctcattgaacctctaatgagtcttgttaaatcctatgaaggtgggagagagagtcatgcccatgttattgttcagtctctgtttgaagagtatttgtctgttgaagaattgttcagtgtcaatatccaggctgatgtgattgaacgtctccgccttcaa

SEQ ID NO: 3366 - DNA, 200 bp, Kochia scoparia
ttgaaggcggagacgttcaatcacatcagcctggatattgacactgaacaattcttcaacagacaaatactcttcaaacagagactgaacaataacatgggcatgactctctctcccaccttcataggatttaacaagactcattagaggttcaatgagccgctcttgagctcctctctccttttcagggcatgaattca

SEQ ID NO: 3367 - DNA, 200 bp, Kochia scoparia
tgtgattgaacgtctccgccttcaacataaaaatgatctatcaaaagttgttgatattgtcctatcacatcagggtgttaagaataaaaataaattgatcctccggctcatggaacaactggtttactcaaatcctgccgcatatcgggataagcttaaacatttttcacaactgaaccataaaacatactctaagttgg

SEQ ID NO: 3368 - DNA, 200 bp, Kochia scoparia
ccaacttagagtatgttttatggttcagttgtgaaaaatgtttaagcttatcccgatatgcggcaggatttgagtaaaccagttgttccatgagccggaggatcaatttatttttattcttaacaccctgatgtgataggacaatatcaacaacttttgatagatcatttttatgttgaaggcggagacgttcaatcaca

SEQ ID NO: 3369 - DNA, 200 bp, Kochia scoparia
aaccataaaacatactctaagttggctcgtaaggcaagtcaattgcttgaacaaacccagttgagtgaacttcgttctaatattgccagaaacctttccgagttagaaatgtttacagaagacggtgaaagcatggacgttacaaaaaggaaaagtgttattaatgaacgtatggatgctcttgttaatactccgcttgc

SEQ ID NO: 3370 - DNA, 200 bp, Kochia scoparia
gcaagcggagtattaacaagagcatccatacgttcattaataacacttttcctttttgtaacgtccatgctttcaccgtcttctgtaaacatttctaactcggaaaggtttctggcaatattagaacgaagttcactcaactgggtttgttcaagcaattgacttgccttacgagccaacttagagtatgttttatggtt

SEQ ID NO: 3371 - DNA, 200 bp, Kochia scoparia
atgctcttgttaatactccgcttgctgttgaagatgcccttgttggcttgttcgatcacagcgatcatacattacaaaggcgggttgttgagacttatatccagaggctttatcaaccttatcttgtaaagggaagtgtcaagatgcagtggcaccgatatggcctcattgcttcttgggagttcatggaggagcacatt

SEQ ID NO: 3372 - DNA, 200 bp, Kochia scoparia
aatgtgctcctccatgaactcccaagaagcaatgaggccatatcggtgccactgcatcttgacacttccctttacaagataaggttgataaagcctctggatataagtctcaacaacccgcctttgtaatgtatgatcgctgtgatcgaacaagccaacaagggcatcttcaacagcaagcggagtattaacaagagcat

SEQ ID NO: 3373 - DNA, 200 bp, Kochia scoparia
ttgggagttcatggaggagcacattgaaagagcaaatgccgctaatgatttgtccatcaaccagcctcttgctgagaaactcattgagagaaaattgggagtcatggtcatcattaaatctcttcagtttttgccaagagtgattactgctgcattaaaagagaccacggataattcagatgaaatgattcccagaggtt

SEQ ID NO: 3374 - DNA, 200 bp, Kochia scoparia
aacctctgggaatcatttcatctgaattatccgtggtctcttttaatgcagcagtaatcactcttggcaaaaactgaagagatttaatgatgaccatgactcccaattttctctcaatgagtttctcagcaagaggctggttgatggacaaatcattagcggcatttgctctttcaatgtgctcctccatgaactcccaa

SEQ ID NO: 3375 - DNA, 200 bp, Kochia scoparia
tcagatgaaatgattcccagaggttctttagattcaatcagtcacggaaataagttgcacattgcacttgtgggtgttaataaccagatgagctcgttgcaggatagtggtgatgaagatcaagctaaagagagaattaataagttggcgaaaatcctgagagagaaagaagtgagctcagttcttcttaacagtggtgt

SEQ ID NO: 3376 - DNA, 200 bp, Kochia scoparia
acaccactgttaagaagaactgagctcacttctttctctctcaggattttcgccaacttattaattctctctttagcttgatcttcatcaccactatcctgcaacgagctcatctggttattaacacccacaagtgcaatgtgcaacttatttccgtgactgattgaatctaaagaacctctgggaatcatttcatctga

SEQ ID NO: 3377 - DNA, 200 bp, Kochia scoparia
gctcagttcttcttaacagtggtgttggggtaattagttgcattatacagagaaatggaggaagaatcccaatgaggcattcattctattggtcagaagagaaacaatactttaatgaagagcctttactacgtcatttggaacctcctctatcaatatatcttgaactggacaagctcaaacactatgaaaatcccaga

SEQ ID NO: 3378 - DNA, 200 bp, Kochia scoparia
tctgggattttcatagtgtttgagcttgtccagttcaagatatattgatagaggaggttccaaatgacgtagtaaaggctcttcattaaagtattgtttctcttctgaccaatagaatgaatgcctcattgggattcttcctccatttctctgtataatgcaactaattaccccaacaccactgttaagaagaactgagc

SEQ ID NO: 3379 - DNA, 200 bp, Kochia scoparia
gctcaaacactatgaaaatcccagatatactccttctcgggatcatcagtggcacctgtatactgtcatggacaagccatctattcgacgaatgtttttgaggacacttgtcagacagcccacctccgagtttagcggggttgaactagaaatgcttaaaacacaaaggcctatctcctttacttcaagaaacatactga

SEQ ID NO: 3380 - DNA, 200 bp, Kochia scoparia
tcagtatgtttcttgaagtaaaggagataggcctttgtgttttaagcatttctagttcaaccccgctaaactcggaggtgggctgtctgacaagtgtcctcaaaaacattcgtcgaatagatggcttgtccatgacagtatacaggtgccactgatgatcccgagaaggagtatatctgggattttcatagtgtttgagc

SEQ ID NO: 3381 - DNA, 200 bp, Kochia scoparia
tcctttacttcaagaaacatactgaggtctttaacaactgcaatggaagaattagaactcaatgcgcacaatgctaccttgaaacctgatcatgctcatatgtacctgtgcattgtaagagagcaacgaattcaagatcttgtcccatatcacagggaggtgaacattgatgatgaacaagaagagataactgttcagat

SEQ ID NO: 3382 - DNA, 200 bp, Kochia scoparia
atctgaacagttatctcttcttgttcatcatcaatgttcacctccctgtgatatgggacaagatcttgaattcgttgctctcttacaatgcacaggtacatatgagcatgatcaggtttcaaggtagcattgtgcgcattgagttctaattcttccattgcagttgttaaagacctcagtatgtttcttgaagtaaagga

SEQ ID NO: 3383 - DNA, 200 bp, Kochia scoparia
aacaagaagagataactgttcagatatatttggaagagcttgcgcgtgaaatccacagttttgctggtgtgagaatgcataaactaaatgtatgtgagtgggaagtaaagctttgggtgtcatcttctggccaagccaatggttcatggagaatcattgttaataatgtgactggtcatacatgcactgtacatgtttac

SEQ ID NO: 3384 - DNA, 200 bp, Kochia scoparia
gtaaacatgtacagtgcatgtatgaccagtcacattattaacaatgattctccatgaaccattggcttggccagaagatgacacccaaagctttacttcccactcacatacatttagtttatgcattctcacaccagcaaaactgtggatttcacgcgcaagctcttccaaatatatctgaacagttatctcttcttgtt

SEQ ID NO: 3385 - DNA, 200 bp, Kochia scoparia
tcatacatgcactgtacatgtttaccgtgagttggaggataacaaccttcatgaaatgatctaccattcaatatctgttcaaggtcctctccatggaataccagtgaatgcaccctatcaaccacttggagtcattgcccgtaaaagacttcaggccaggaaaaatagcacaacctattgttatgacttcccactgaaag

SEQ ID NO: 3386 - DNA, 200 bp, Kochia scoparia
ctttcagtgggaagtcataacaataggttgtgctatttttcctggcctgaagtcttttacgggcaatgactccaagtggttgatagggtgcattcactggtattccatggagaggaccttgaacagatattgaatggtagatcatttcatgaaggttgttatcctccaactcacggtaaacatgtacagtgcatgtatga

SEQ ID NO: 3387 - DNA, 200 bp, Kochia scoparia
tattgttatgacttcccactgaaagctgaaatcacccttggggacgcatgtgaagcttaccgccatccccggagacgtccccaaaagtcaacgccgttcccggaagtcaatggcgtcccgaggacgtccccaagccgtccccggcgcgtttccgtccccgttctgtccccggctttctctactgccttggagcaatcatg

SEQ ID NO: 3388 - DNA, 200 bp, Kochia scoparia
catgattgctccaaggcagtagagaaagccggggacagaacggggacggaaacgcgccggggacggcttggggacgtcctcgggacgccattgacttccgggaacggcgttgacttttggggacgtctccggggatggcggtaagcttcacatgcgtccccaagggtgatttcagctttcagtgggaagtcataacaata

SEQ ID NO: 3389 - DNA, 200 bp, Kochia scoparia
tctctactgccttggagcaatcatgggcatcccaacctccgctgctgaagaaacccacaaacaaaaaagttttgaaagtctcagagctagtatttgctgatgcaaatggcacctggggaacacaagttgtcccaacagaccgtgaacctggtcttaataatattggcatggtggcctggtccatggagatgtcaactcct

SEQ ID NO: 3390 - DNA, 200 bp, Kochia scoparia
aggagttgacatctccatggaccaggccaccatgccaatattattaagaccaggttcacggtctgttgggacaacttgtgttccccaggtgccatttgcatcagcaaatactagctctgagactttcaaaacttttttgtttgtgggtttcttcagcagcggaggttgggatgcccatgattgctccaaggcagtagaga

SEQ ID NO: 3391 - DNA, 200 bp, Kochia scoparia
ctggtccatggagatgtcaactcctgaatttcctgatggaaggaccatattggttgtagcaaatgatatcaccttcatggctggatcatttgggccaaaagaagatgctctcttccgggcagttacagatcttgcttgttccaaaaaaattcctctgatttacctggctgctaattctggtgcccgactgggtgttgctg

SEQ ID NO: 3392 - DNA, 200 bp, Kochia scoparia
cagcaacacccagtcgggcaccagaattagcagccaggtaaatcagaggaatttttttggaacaagcaagatctgtaactgcccggaagagagcatcttcttttggcccaaatgatccagccatgaaggtgatatcatttgctacaaccaatatggtccttccatcaggaaattcaggagttgacatctccatggaccag

SEQ ID NO: 3393 - DNA, 200 bp, Kochia scoparia
tctggtgcccgactgggtgttgctgaagaggtaagagcgtgctttaaaattggttggtctgatgaactgaaccctgaacgggggttccagtatatctacttgactcctgaagattatggtcgtatagggtcagcagttatagcccatgagttagaactccaaaatggagagactcggtgggttatagacactattgtagg

SEQ ID NO: 3394 - DNA, 200 bp, Kochia scoparia
cctacaatagtgtctataacccaccgagtctctccattttggagttctaactcatgggctataactgctgaccctatacgaccataatcttcaggagtcaagtagatatactggaacccccgttcagggttcagttcatcagaccaaccaattttaaagcacgctcttacctcttcagcaacacccagtcgggcaccaga

SEQ ID NO: 3395 - DNA, 200 bp, Kochia scoparia
ggtgggttatagacactattgtagggaaggaggatgggttaggtgttgagaacttatccggaagtgcggctatagctggtgcctattcaagggcatacaaagaaacttttacactaacttttgtaacaggaagaacagttggtattggtgcctatcttgctcgccttgggatgcgttgtatccaaaggcttgatcagccc

SEQ ID NO: 3396 - DNA, 200 bp, Kochia scoparia
gggctgatcaagcctttggatacaacgcatcccaaggcgagcaagataggcaccaataccaactgttcttcctgttacaaaagttagtgtaaaagtttctttgtatgcccttgaataggcaccagctatagccgcacttccggataagttctcaacacctaacccatcctccttccctacaatagtgtctataacccacc

SEQ ID NO: 3397 - DNA, 200 bp, Kochia scoparia
ttgtatccaaaggcttgatcagcccattattctgacaggcttttcaacattaaataaacttcttggtcgtgaggtttacagctcacaaatgcaacttggtgggcccaagattatgggtacaaacggtgttgttcatttaacagtttcagatgaccttgaaggcatttcatctattatcaaatggcttagctatgttccat

SEQ ID NO: 3398 - DNA, 200 bp, Kochia scoparia
atggaacatagctaagccatttgataatagatgaaatgccttcaaggtcatctgaaactgttaaatgaacaacaccgtttgtacccataatcttgggcccaccaagttgcatttgtgagctgtaaacctcacgaccaagaagtttatttaatgttgaaaagcctgtcagaataatgggctgatcaagcctttggatacaa

SEQ ID NO: 3399 - DNA, 200 bp, Kochia scoparia
atcaaatggcttagctatgttccatcctattcaggaggtgaacttcctatttcacgttctttagatcctccagaaagacaggttgagtatttgcctgacaattcttgcgatccccgttctgccatatctggtacacttgactctgatggtaattggcttggtggaattttcgacaaagatagttttgttgaaaccctaca

SEQ ID NO: 3400 - DNA, 200 bp, Kochia scoparia
tgtagggtttcaacaaaactatctttgtcgaaaattccaccaagccaattaccatcagagtcaagtgtaccagatatggcagaacggggatcgcaagaattgtcaggcaaatactcaacctgtctttctggaggatctaaagaacgtgaaataggaagttcacctcctgaataggatggaacatagctaagccatttgat

SEQ ID NO: 3401 - DNA, 200 bp, Kochia scoparia
aagatagttttgttgaaaccctacaaggctgggcaaggacagttatcactggccgcgccaaacttggtggaattccagttgggatagttgctgttgagacacaaactgtgatgcaagctatcccagctgatcctggtcagcttgattctcatgagcgagttgtctcacaagctggacaagtatggtttccggattctgca

SEQ ID NO: 3402 - DNA, 200 bp, Kochia scoparia
tgcagaatccggaaaccatacttgtccagcttgtgagacaactcgctcatgagaatcaagctgaccaggatcagctgggatagcttgcatcacagtttgtgtctcaacagcaactatcccaactggaattccaccaagtttggcgcggccagtgataactgtccttgcccagccttgtagggtttcaacaaaactatctt

SEQ ID NO: 3403 - DNA, 200 bp, Kochia scoparia
acaagtatggtttccggattctgcaactaagacagcacaagctttgatggattttaacagggaaggacttccacttttcattctagctaactggagagggttctctggagggcaaagggatctctttgaagggattcttcaggcaggttccacaattgtcgagaaccttaggacttataatcaacctatttttgtttata

SEQ ID NO: 3404 - DNA, 200 bp, Kochia scoparia
tataaacaaaaataggttgattataagtcctaaggttctcgacaattgtggaacctgcctgaagaatcccttcaaagagatccctttgccctccagagaaccctctccagttagctagaatgaaaagtggaagtccttccctgttaaaatccatcaaagcttgtgctgtcttagttgcagaatccggaaaccatacttgt

SEQ ID NO: 3405 - DNA, 200 bp, Kochia scoparia
tataatcaacctatttttgtttatatccccatgatgggtgaacttcgtggtggcgcgtgggttgtcgtagacagtcgaatcaattcggaccagattgagatgtatgctgaccagacagcaaaaggaaatgttcttgagccagaaggaatgattgaggtgaagtttagaaccaaggaattaattgaatgtatggaaaggct

SEQ ID NO: 3406 - DNA, 200 bp, Kochia scoparia
agcctttccatacattcaattaattccttggttctaaacttcacctcaatcattccttctggctcaagaacatttccttttgctgtctggtcagcatacatctcaatctggtccgaattgattcgactgtctacgacaacccacgcgccaccacgaagttcacccatcatggggatataaacaaaaataggttgattata

SEQ ID NO: 3407 - DNA, 200 bp, Kochia scoparia
aattaattgaatgtatggaaaggcttgatcaacatcttatcaatcttaatgcaaaacttgttgaagccaaaaactccaattcatcggatgacatcaaacccctcaaacagcagatagaagctcggcagaagcaacttttgcctctatatactcaaatagccacaaaatttgctgacttgcatgatagtccttatagaatg

SEQ ID NO: 3408 - DNA, 200 bp, Kochia scoparia
cattctataaggactatcatgcaagtcagcaaattttgtggctatttgagtatatagaggcaaaagttgcttctgccgagcttctatctgctgtttgaggggtttgatgtcatccgatgaattggagtttttggcttcaacaagttttgcattaagattgataagatgttgatcaagcctttccatacattcaattaatt

SEQ ID NO: 3409 - DNA, 200 bp, Kochia scoparia
cttgcatgatagtccttatagaatggctgcgaaaggagttgtcaaggaagtcctggattggagcaattctcgctcattcttccacaaaagactgtacaggagagtaatggaggaatcacttgtcaagactgtccgagatgctgctggtgaagcaatgacccacaagtctgccttggagttgatcaagcaatggcttgctg

SEQ ID NO: 3410 - DNA, 200 bp, Kochia scoparia
cagcaagccattgcttgatcaactccaaggcagacttgtgggtcattgcttcaccagcagcatctcggacagtcttgacaagtgattcctccattactctcctgtacagtcttttgtggaagaatgagcgagaattgctccaatccaggacttccttgacaactcctttcgcagccattctataaggactatcatgcaag

SEQ ID NO: 3411 - DNA, 200 bp, Kochia scoparia
gagttgatcaagcaatggcttgctgagtctgccatggatagtactactagagcgggagctgatgcttgggctgacgatgaagctttcttcaggtggaaagaaaatcctgctaattatgaagaaaagctaattgagttacgcatacagaaagtattgcatcagctttcaaatattgacaactcagcttctgatctgagagc

SEQ ID NO: 3412 - DNA, 200 bp, Kochia scoparia
gctctcagatcagaagctgagttgtcaatatttgaaagctgatgcaatactttctgtatgcgtaactcaattagcttttcttcataattagcaggattttctttccacctgaagaaagcttcatcgtcagcccaagcatcagctcccgctctagtagtactatccatggcagactcagcaagccattgcttgatcaactc

SEQ ID NO: 3413 - DNA, 200 bp, Kochia scoparia
atgtctttgcatttggtgaatcaagagggttggccatagcaaatatggttcttggcttgaaagaaattcaaattcgtggagaaattcgcactaatgttgattataccattgatcttttaaacgtgagccttatacatgaatttcccccctacactgttcactgttttttcaattagaagctaaacttgtctttgtttttc

SEQ ID NO: 3414 - DNA, 200 bp, Kochia scoparia
gaaaaacaaagacaagtttagcttctaattgaaaaaacagtgaacagtgtaggggggaaattcatgtataaggctcacgtttaaaagatcaatggtataatcaacattagtgcgaatttctccacgaatttgaatttctttcaagccaagaaccatatttgctatggccaaccctcttgattcaccaaatgcaaagacat

SEQ ID NO: 3415 - DNA, 200 bp, Kochia scoparia
gaagctaaacttgtctttgtttttcctttctccagtcttcggattacagagataataaaattcacacaggttggttagatagcagaattgcaatgagagtcagagcggaaaggcccccctggttcatctctgtggtgggaggtgcactctacgtatgtacaacttttctcttaaattttcttccttcctcaagcttcatg

SEQ ID NO: 3416 - DNA, 200 bp, Kochia scoparia
catgaagcttgaggaaggaagaaaatttaagagaaaagttgtacatacgtagagtgcacctcccaccacagagatgaaccaggggggcctttccgctctgactctcattgcaattctgctatctaaccaacctgtgtgaattttattatctctgtaatccgaagactggagaaaggaaaaacaaagacaagtttagcttc

SEQ ID NO: 3417 - DNA, 200 bp, Kochia scoparia
ttttcttccttcctcaagcttcatgtgtcactttcgtttatttttataatgaataattttaaatgattctttctcctttctccctatcttcagaaagcttctgctagtagtgcggctactgtttcagaatatattggctatcttgagaaaggtcaaattcctccaaaggtaatccaaataccagatgctgttgagatata

SEQ ID NO: 3418 - DNA, 200 bp, Kochia scoparia
tatatctcaacagcatctggtatttggattacctttggaggaatttgacctttctcaagatagccaatatattctgaaacagtagccgcactactagcagaagctttctgaagatagggagaaaggagaaagaatcatttaaaattattcattataaaaataaacgaaagtgacacatgaagcttgaggaaggaagaaaa

SEQ ID NO: 3419 - DNA, 200 bp, Kochia scoparia
aaataccagatgctgttgagatatacttgttttttaaacactaattgtttctttcagtaaattacatcaacatttgtgtggattgcagcatatatcacttgtccactcggaagttactttgaatattgaggggagcaagtacactgtaagtttattattaactgatgtgaattttatttttcgttcatggtttctcctgt

SEQ ID NO: 3420 - DNA, 200 bp, Kochia scoparia
acaggagaaaccatgaacgaaaaataaaattcacatcagttaataataaacttacagtgtacttgctcccctcaatattcaaagtaacttccgagtggacaagtgatatatgctgcaatccacacaaatgttgatgtaatttactgaaagaaacaattagtgtttaaaaaacaagtatatctcaacagcatctggtattt

SEQ ID NO: 3421 - DNA, 200 bp, Kochia scoparia
atttttcgttcatggtttctcctgtttacttgttgttaatcatcataacatggttgattctgttctccagatcaaaatggtgaggggcggtccaggaagctacagattgagattgaacgagtcagagattgaggcagaaatacatacattaagagatgggggtcttttgatgcaagtaagaacttaattttattgattca

SEQ ID NO: 3422 - DNA, 200 bp, Kochia scoparia
tgaatcaataaaattaagttcttacttgcatcaaaagacccccatctcttaatgtatgtatttctgcctcaatctctgactcgttcaatctcaatctgtagcttcctggaccgcccctcaccattttgatctggagaacagaatcaaccatgttatgatgattaacaacaagtaaacaggagaaaccatgaacgaaaaat

SEQ ID NO: 3423 - DNA, 200 bp, Kochia scoparia
gtaagaacttaattttattgattcatatattcatgattgaggacaattataaacctcaagctatacgcataggaattataatttgtatagagagttaaaattgcgagtgaaagctaagatattgcaccaacatgtattaagtctatcatccaccacataatgctgaagttacctccgttaattaaatttaaaaaacagga

SEQ ID NO: 3424 - DNA, 200 bp, Kochia scoparia
tcctgttttttaaatttaattaacggaggtaacttcagcattatgtggtggatgatagacttaatacatgttggtgcaatatcttagctttcactcgcaattttaactctctatacaaattataattcctatgcgtatagcttgaggtttataattgtcctcaatcatgaatatatgaatcaataaaattaagttcttac

SEQ ID NO: 3425 - DNA, 200 bp, Kochia scoparia
cgttaattaaatttaaaaaacaggagagtgtagaaattagatagtctaagtttctgtagtcataatgatatgtcttttggaaagtgccccaatgtgttacatttatcttttacccctaacttagtttaggagggaaagctgacttagcaacttctcctctagtacaggatataaatgctcaaaactcttagaatatctaa

SEQ ID NO: 3426 - DNA, 200 bp, Kochia scoparia
ttagatattctaagagttttgagcatttatatcctgtactagaggagaagttgctaagtcagctttccctcctaaactaagttaggggtaaaagataaatgtaacacattggggcactttccaaaagacatatcattatgactacagaaacttagactatctaatttctacactctcctgttttttaaatttaattaacg

SEQ ID NO: 3427 - DNA, 200 bp, Kochia scoparia
tgctcaaaactcttagaatatctaaatttgaaaagattataatgtattattgacattgtttcagagaatgattttctgtatgaactccttaagtatgttttttgacaactccttaagtatgttaatagcaatgccacaaccctgttccacattaggtaggtatatatgtttctgattagaaattatattccatatctccg

SEQ ID NO: 3428 - DNA, 200 bp, Kochia scoparia
cggagatatggaatataatttctaatcagaaacatatatacctacctaatgtggaacagggttgtggcattgctattaacatacttaaggagttgtcaaaaaacatacttaaggagttcatacagaaaatcattctctgaaacaatgtcaataatacattataatcttttcaaatttagatattctaagagttttgagca

SEQ ID NO: 3429 - DNA, 200 bp, Kochia scoparia
ttagaaattatattccatatctccgtataagatcttccttcttaccaacacgagccatataattttgggattaagtagatgatgttggtttgcattatgatgatacttaatatacccacatgtttcatattttcattgacttaaacgctatcttctagaaaaggggtagttgttgatccaatgtatgtgctacattctca

SEQ ID NO: 3430 - DNA, 200 bp, Kochia scoparia
tgagaatgtagcacatacattggatcaacaactaccccttttctagaagatagcgtttaagtcaatgaaaatatgaaacatgtgggtatattaagtatcatcataatgcaaaccaacatcatctacttaatcccaaaattatatggctcgtgttggtaagaaggaagatcttatacggagatatggaatataatttctaa

SEQ ID NO: 3431 - DNA, 200 bp, Kochia scoparia
atccaatgtatgtgctacattctcatccctttgatttcaactagctatggattttgagctattctgtgcatttgaatgtgatgcagttggatgggaacagtcatgtgatatatgctgaggaagaggcagcaggaactcgccttcttattgatggacgaacatgtttgcttcaggtaccatcttgttatttaattgcataa

SEQ ID NO: 3432 - DNA, 200 bp, Kochia scoparia
ttatgcaattaaataacaagatggtacctgaagcaaacatgttcgtccatcaataagaaggcgagttcctgctgcctcttcctcagcatatatcacatgactgttcccatccaactgcatcacattcaaatgcacagaatagctcaaaatccatagctagttgaaatcaaagggatgagaatgtagcacatacattggat

SEQ ID NO: 3433 - DNA, 200 bp, Kochia scoparia
accatcttgttatttaattgcataatatttctaaatctttaccaagcgtaacctagtattaaatatcccccttctttgtatccagaatgatcatgatccttcaaagttaattgcggaaacaccttgtaagctgatgcggtatttggtcccagataatagtcacattgatccagatactccatttgctgaagttgaggtta

SEQ ID NO: 3434 - DNA, 200 bp, Kochia scoparia
taacctcaacttcagcaaatggagtatctggatcaatgtgactattatctgggaccaaataccgcatcagcttacaaggtgtttccgcaattaactttgaaggatcatgatcattctggatacaaagaagggggatatttaatactaggttacgcttggtaaagatttagaaatattatgcaattaaataacaagatggt

SEQ ID NO: 3435 - DNA, 200 bp, Kochia scoparia
actccatttgctgaagttgaggttatgaagatgtgtatgcctttgctttcccctgcatctggtaaaatacaatttaagatgtccgaaggacaagccatgcaggttagcataggttttggaaaatctatatgttaactaattatactctaaaagttttttctaagtgcgtgttcgctgtgtaggctggcgagctcatagca

SEQ ID NO: 3436 - DNA, 200 bp, Kochia scoparia
tgctatgagctcgccagcctacacagcgaacacgcacttagaaaaaacttttagagtataattagttaacatatagattttccaaaacctatgctaacctgcatggcttgtccttcggacatcttaaattgtattttaccagatgcaggggaaagcaaaggcatacacatcttcataacctcaacttcagcaaatggagt

SEQ ID NO: 3437 - DNA, 200 bp, Kochia scoparia
tgtgtaggctggcgagctcatagcaagacttgagttggatgatccttcagctgtaagaaaagctgaacctttccgtggcagttttccaattttgggccccccaactgctatctcaggaaaagttcatcaaagatgtgttgcaagtttgaatgcagcccagatgattcttgctggttatgaacacaacatagatgaagtaa

SEQ ID NO: 3438 - DNA, 200 bp, Kochia scoparia
ttacttcatctatgttgtgttcataaccagcaagaatcatctgggctgcattcaaacttgcaacacatctttgatgaacttttcctgagatagcagttggggggcccaaaattggaaaactgccacggaaaggttcagcttttcttacagctgaaggatcatccaactcaagtcttgctatgagctcgccagcctacaca

SEQ ID NO: 3439 - DNA, 200 bp, Kochia scoparia
tatgaacacaacatagatgaagtaagtatttcaatagtgaattcaaaaaatcgagcaatatattatatacatgaagtattcctattatgaatttaacatagatgatgtaagtattcctctgaggggctgatgcaaaaatttgagatgtatatgtatgtctatttatattttggttggttcccttatcagaaagattcttt

SEQ ID NO: 3440 - DNA, 200 bp, Kochia scoparia
aaagaatctttctgataagggaaccaaccaaaatataaatagacatacatatacatctcaaatttttgcatcagcccctcagaggaatacttacatcatctatgttaaattcataataggaatacttcatgtatataatatattgctcgattttttgaattcactattgaaatacttacttcatctatgttgtgttcata

SEQ ID NO: 3441 - DNA, 200 bp, Kochia scoparia
ggttcccttatcagaaagattctttacaaatgagttttctaattctcaggttgtccagagtttgctgatttgccttgatagtcctgaacttcctttcctgcaatggcaagaatgcttgtctgttctagcaacacggcttcccaaagatctgagaactgaagtatgctactaagttctgcatgcaattctttttctatatt

SEQ ID NO: 3442 - DNA, 200 bp, Kochia scoparia
aatatagaaaaagaattgcatgcagaacttagtagcatacttcagttctcagatctttgggaagccgtgttgctagaacagacaagcattcttgccattgcaggaaaggaagttcaggactatcaaggcaaatcagcaaactctggacaacctgagaattagaaaactcatttgtaaagaatctttctgataagggaacc

SEQ ID NO: 3443 - DNA, 200 bp, Kochia scoparia
ctgcatgcaattctttttctatatttgataaacacctgttgtctttagcagtctttatcttcttttttctttctttctttttctctgtaactcacattattttaccatgtttccttatctttggttttatcagttggagtcaaaatatggaaaattcgaaggagttaccaattctcagaacattgaatttcctgctaagc

SEQ ID NO: 3444 - DNA, 200 bp, Kochia scoparia
gcttagcaggaaattcaatgttctgagaattggtaactccttcgaattttccatattttgactccaactgataaaaccaaagataaggaaacatggtaaaataatgtgagttacagagaaaaagaaagaaagaaaaaagaagataaagactgctaaagacaacaggtgtttatcaaatatagaaaaagaattgcatgcag

SEQ ID NO: 3445 - DNA, 200 bp, Kochia scoparia
cagaacattgaatttcctgctaagctgtttaaaggtgttcttgaggtcagtctttctttttgttacccttctgtatatgatacagtttgagtgttacttacataagtattttgtttacaggctcatttgaattcatgccctgaaaaggagagaggagctcaagagcggctcattgaacctctaatgagtcttgttaaatc

SEQ ID NO: 3446 - DNA, 200 bp, Kochia scoparia
gatttaacaagactcattagaggttcaatgagccgctcttgagctcctctctccttttcagggcatgaattcaaatgagcctgtaaacaaaatacttatgtaagtaacactcaaactgtatcatatacagaagggtaacaaaaagaaagactgacctcaagaacacctttaaacagcttagcaggaaattcaatgttctg

SEQ ID NO: 3447 - DNA, 200 bp, Kochia scoparia
aacctctaatgagtcttgttaaatcctatgaaggtgggagagagagtcatgcccatgttattgttcagtctctgtttgaagagtatttgactgttgaagaattgttcagtgacaatatccaggtttgttattgcagttgcaaattgatcagtttttttggtcaaccaatttgtaccgggacaaattgccacagtcctaat

SEQ ID NO: 3448 - DNA, 200 bp, Kochia scoparia
attaggactgtggcaatttgtcccggtacaaattggttgaccaaaaaaactgatcaatttgcaactgcaataacaaacctggatattgtcactgaacaattcttcaacagtcaaatactcttcaaacagagactgaacaataacatgggcatgactctctctcccaccttcataggatttaacaagactcattagaggtt

SEQ ID NO: 3449 - DNA, 200 bp, Kochia scoparia
cgggacaaattgccacagtcctaatttattgatgatcatcggtcttcgtgtttttttcccggtttggttgattggttatcatgttatgaagttgtcacataaaaaaacctaaatttactaatgcacccatttgaccctagaggctacagagtctttggagtactctgtctctgtggatttatagtagcatcctttgaagt

SEQ ID NO: 3450 - DNA, 200 bp, Kochia scoparia
acttcaaaggatgctactataaatccacagagacagagtactccaaagactctgtagcctctagggtcaaatgggtgcattagtaaatttaggtttttttatgtgacaacttcataacatgataaccaatcaaccaaaccgggaaaaaaacacgaagaccgatgatcatcaataaattaggactgtggcaatttgtcccg

SEQ ID NO: 3451 - DNA, 200 bp, Kochia scoparia
gatttatagtagcatcctttgaagtattactttattttttcaagaaattgtagttcatgtcttttgattctgatcttgaaaggaaggctgacatcattccactttattttctaatttcaatctatacaggctgatgtgattgaacgtctccgccttcaacataaaaaagacctgttaaaggttgttgacattgtcctatc

SEQ ID NO: 3452 - DNA, 200 bp, Kochia scoparia
gataggacaatgtcaacaacctttaacaggtcttttttatgttgaaggcggagacgttcaatcacatcagcctgtatagattgaaattagaaaataaagtggaatgatgtcagccttcctttcaagatcagaatcaaaagacatgaactacaatttcttgaaaaaataaagtaatacttcaaaggatgctactataaatc

SEQ ID NO: 3453 - DNA, 200 bp, Kochia scoparia
taaaggttgttgacattgtcctatcacatcaggtaggcaggaaatttcaaataattcaaattaagtttgagttttcttttcccttttcccttgtaatatcttccaggcttgtttactatgtagtaataatggctttcagggtgttaagaacaaaaataaattgattctccggctcatggaacaactggtttacccaaatc

SEQ ID NO: 3454 - DNA, 200 bp, Kochia scoparia
gatttgggtaaaccagttgttccatgagccggagaatcaatttatttttgttcttaacaccctgaaagccattattactacatagtaaacaagcctggaagatattacaagggaaaagggaaaagaaaactcaaacttaatttgaattatttgaaatttcctgcctacctgatgtgataggacaatgtcaacaaccttta

SEQ ID NO: 3455 - DNA, 200 bp, Kochia scoparia
atggaacaactggtttacccaaatcctgccgcataccgggagaagcttatccgtttttcacaactaaaccatacaatctactctgaggttagtgattattcaattttttgtttatattgtcacactacagcattcacaaaaaggttattaagtttatacactaatcaattccttcactatatgcagttggcacttaaggc

SEQ ID NO: 3456 - DNA, 200 bp, Kochia scoparia
gccttaagtgccaactgcatatagtgaaggaattgattagtgtataaacttaataacctttttgtgaatgctgtagtgtgacaatataaacaaaaaattgaataatcactaacctcagagtagattgtatggtttagttgtgaaaaacggataagcttctcccggtatgcggcaggatttgggtaaaccagttgttccat

SEQ ID NO: 3457 - DNA, 200 bp, Kochia scoparia
actatatgcagttggcacttaaggcaagtcaattgcttgaacaaaccaagttgagtgaacttcgttctaatattgccagaaacctttccgagttagaaatgtttacagaagatggtgaaaacatggacactccaaaaaggaaaagtgctattaatgagcgtatggaggctcttgtgaatactccgcttgctgttgaagat

SEQ ID NO: 3458 - DNA, 200 bp, Kochia scoparia
atcttcaacagcaagcggagtattcacaagagcctccatacgctcattaatagcacttttcctttttggagtgtccatgttttcaccatcttctgtaaacatttctaactcggaaaggtttctggcaatattagaacgaagttcactcaacttggtttgttcaagcaattgacttgccttaagtgccaactgcatatagt

SEQ ID NO: 3459 - DNA, 200 bp, Kochia scoparia
gaatactccgcttgctgttgaagatgcccttgttggcttgttcgatcacagcgatcatacgttacaaaggcgggttgttgagacttatgtccggagactttatcaagtaatatctaagttccaacagtaaactttaactatcatttaataatgttatgtcatataactctattttttgtgggtaatctcttttctcagcc

SEQ ID NO: 3460 - DNA, 200 bp, Kochia scoparia
ggctgagaaaagagattacccacaaaaaatagagttatatgacataacattattaaatgatagttaaagtttactgttggaacttagatattacttgataaagtctccggacataagtctcaacaacccgcctttgtaacgtatgatcgctgtgatcgaacaagccaacaagggcatcttcaacagcaagcggagtattc

SEQ ID NO: 3461 - DNA, 200 bp, Kochia scoparia
ttgtgggtaatctcttttctcagccttatcttgtaaaaggaagtgtcaggatgcagtggcacagatctggcctcattgtttcttgggagttcatggaggagcacattgaaagagcaaatgcctctaatgatctgtccatcaaccagccccttgttgagaaacacagtgagagaaaatggggagccatggtcatcataaaa

SEQ ID NO: 3462 - DNA, 200 bp, Kochia scoparia
ttttatgatgaccatggctccccattttctctcactgtgtttctcaacaaggggctggttgatggacagatcattagaggcatttgctctttcaatgtgctcctccatgaactcccaagaaacaatgaggccagatctgtgccactgcatcctgacacttccttttacaagataaggctgagaaaagagattacccacaa

SEQ ID NO: 3463 - DNA, 200 bp, Kochia scoparia
atggggagccatggtcatcataaaatctcttcagtttttgccaacagtgattactgctgcattaaaagagacaacacataattcagatgaaacgattcccagaggctctttagaatcaatcagtcatggaaatatgttgcacattgcacttgtgggtgttaataaccagatgagcttgttgcaggataggtatagattct

SEQ ID NO: 3464 - DNA, 200 bp, Kochia scoparia
agaatctatacctatcctgcaacaagctcatctggttattaacacccacaagtgcaatgtgcaacatatttccatgactgattgattctaaagagcctctgggaatcgtttcatctgaattatgtgttgtctcttttaatgcagcagtaatcactgttggcaaaaactgaagagattttatgatgaccatggctccccat

SEQ ID NO: 3465 - DNA, 200 bp, Kochia scoparia
ttgttgcaggataggtatagattctatttttatggtttaagcaagattttaaaatgtgaacattggactatccaattttatttatgtttatttatttatttatttttttgacgaggactatccagtttttttgaagaaatatgctttgcttcaattatgcagtcgctctttatagtaaccattccggccttttgcttaac

SEQ ID NO: 3466 - DNA, 200 bp, Kochia scoparia
gttaagcaaaaggccggaatggttactataaagagcgactgcataattgaagcaaagcatatttcttcaaaaaaactggatagtcctcgtcaaaaaaataaataaataaataaacataaataaaattggatagtccaatgttcacattttaaaatcttgcttaaaccataaaaatagaatctatacctatcctgcaacaa

SEQ ID NO: 3467 - DNA, 200 bp, Kochia scoparia
taaccattccggccttttgcttaacctttttttctctgtggggtttatgaaatggaattttatactatgcagtggtgatgaagatcaagctcaagagagaattgataagttggcaaaaatcctgagagagaaagaagtgagctcaggtcttcgtgacgttggtgtcagggtaattagttgcattatacagagagatgaag

SEQ ID NO: 3468 - DNA, 200 bp, Kochia scoparia
cttcatctctctgtataatgcaactaattaccctgacaccaacgtcacgaagacctgagctcacttctttctctctcaggatttttgccaacttatcaattctctcttgagcttgatcttcatcaccactgcatagtataaaattccatttcataaaccccacagagaaaaaaaggttaagcaaaaggccggaatggtta

SEQ ID NO: 3469 - DNA, 200 bp, Kochia scoparia
agttgcattatacagagagatgaaggaagaacgccaatgaggcattcattctattggtcagaagagaaacaatacttcaatgaagagcctttactacgtcatttggaacctcctctatcaatatatcttgaattggtatgatattctgagcaagaagctgtttcttgtttattattttcttgtttcttaatatgggtcaa

SEQ ID NO: 3470 - DNA, 200 bp, Kochia scoparia
ttgacccatattaagaaacaagaaaataataaacaagaaacagcttcttgctcagaatatcataccaattcaagatatattgatagaggaggttccaaatgacgtagtaaaggctcttcattgaagtattgtttctcttctgaccaatagaatgaatgcctcattggcgttcttccttcatctctctgtataatgcaact

SEQ ID NO: 3471 - DNA, 200 bp, Kochia scoparia
tttcttgtttcttaatatgggtcaaatcattatctttaacatttttgtcactatttgatatagttataaggtatttggctcacaactttccttacacaggacaagctcaaggtctatgaaaatcccaaatatactccttctcgggatcgtcaatggcacctgtatactgtcatggacaagccatctattcgacgaatgtt

SEQ ID NO: 3472 - DNA, 200 bp, Kochia scoparia
aacattcgtcgaatagatggcttgtccatgacagtatacaggtgccattgacgatcccgagaaggagtatatttgggattttcatagaccttgagcttgtcctgtgtaaggaaagttgtgagccaaataccttataactatatcaaatagtgacaaaaatgttaaagataatgatttgacccatattaagaaacaagaaa

SEQ ID NO: 3473 - DNA, 200 bp, Kochia scoparia
acaagccatctattcgacgaatgtttttgaggacacttgtcagacagcccacttccgagttcagtggggttgaactaaaaattcttcaaacacaaaggcccatctcctttacttcaagaagcattctgaggtctttaacaactgcaatggaagaattagaactcaatgcgcacaatgctaccttgaaacctgatcatgct

SEQ ID NO: 3474 - DNA, 200 bp, Kochia scoparia
agcatgatcaggtttcaaggtagcattgtgcgcattgagttctaattcttccattgcagttgttaaagacctcagaatgcttcttgaagtaaaggagatgggcctttgtgtttgaagaatttttagttcaaccccactgaactcggaagtgggctgtctgacaagtgtcctcaaaaacattcgtcgaatagatggcttgt

SEQ ID NO: 3475 - DNA, 200 bp, Kochia scoparia
tgctaccttgaaacctgatcatgctaatatgtacctgtacattgtaagagagcaacaaatacatgatcttgtcccatatcacaggttctaattactattcttaattttatgtgtctcatttgtggttattgatgcaacttatgctttaagagggattattttgatccgttaatccagggaggtgaacattgatgacgaac

SEQ ID NO: 3476 - DNA, 200 bp, Kochia scoparia
gttcgtcatcaatgttcacctccctggattaacggatcaaaataatccctcttaaagcataagttgcatcaataaccacaaatgagacacataaaattaagaatagtaattagaacctgtgatatgggacaagatcatgtatttgttgctctcttacaatgtacaggtacatattagcatgatcaggtttcaaggtagca

SEQ ID NO: 3477 - DNA, 200 bp, Kochia scoparia
agggaggtgaacattgatgacgaacaagaagagacagctgttcatatgtacttggaagagcttgcgcttgaaatccacagttgtgctggtgtgagaatgcataaactaaatgtatgtgagtgggaagtaaaactttggatatcatcttctggtcaagccaatggttcatggagaatcattgttactaatgtgactggtca

SEQ ID NO: 3478 - DNA, 200 bp, Kochia scoparia
tgaccagtcacattagtaacaatgattctccatgaaccattggcttgaccagaagatgatatccaaagttttacttcccactcacatacatttagtttatgcattctcacaccagcacaactgtggatttcaagcgcaagctcttccaagtacatatgaacagctgtctcttcttgttcgtcatcaatgttcacctccct

SEQ ID NO: 3479 - DNA, 200 bp, Kochia scoparia
tcattgttactaatgtgactggtcatacatgcactgtacatgtaagtttgaactatgataattttttcctataattttctgtaaaggtttttagtattggccgtgtttagtaatttctttcaacactcagatatttatgccagtttttgtaagaattacagaaatagtagcatgtttttagtgcccaagttctttctttg

SEQ ID NO: 3480 - DNA, 200 bp, Kochia scoparia
caaagaaagaacttgggcactaaaaacatgctactatttctgtaattcttacaaaaactggcataaatatctgagtgttgaaagaaattactaaacacggccaatactaaaaacctttacagaaaattataggaaaaaattatcatagttcaaacttacatgtacagtgcatgtatgaccagtcacattagtaacaatga

SEQ ID NO: 3481 - DNA, 200 bp, Kochia scoparia
ttttagtgcccaagttctttctttgtccttttgcccagcaatatctttaataatttatgtataaactataagatattatgagactatacatcgagaaaaatctaaatacatcttccattacaacctttgatttttttttttttttttaaattgaaaaaacaatgggtaaaggtgatacatgaatcttgtaaaacacaaac

SEQ ID NO: 3482 - DNA, 200 bp, Kochia scoparia
gtttgtgttttacaagattcatgtatcacctttacccattgttttttcaatttaaaaaaaaaaaaaaaaatcaaaggttgtaatggaagatgtatttagatttttctcgatgtatagtctcataatatcttatagtttatacataaattattaaagatattgctgggcaaaaggacaaagaaagaacttgggcactaaaa

SEQ ID NO: 3483 - DNA, 200 bp, Kochia scoparia
tacatgaatcttgtaaaacacaaacaatgaccatacatatgggacggagggagtaataatggtttgtatattggcacttataaagaaaaaggttatgcacaattaatttatgtcttgtagacgtgtatcacataatgtcttctttagtttgctgacctttttctactaatgttatgcaggtttaccgtgagttggaggat

SEQ ID NO: 3484 - DNA, 200 bp, Kochia scoparia
atcctccaactcacggtaaacctgcataacattagtagaaaaaggtcagcaaactaaagaagacattatgtgatacacgtctacaagacataaattaattgtgcataacctttttctttataagtgccaatatacaaaccattattactccctccgtcccatatgtatggtcattgtttgtgttttacaagattcatgta

SEQ ID NO: 3485 - DNA, 200 bp, Kochia scoparia
gcaggtttaccgtgagttggaggataacaaccttcatgaaatgatctaccattcagtatctgttcaaggtcctcttcatggaataccagtgaatgcaccctatcaaccacttggagtcattgctcgtaaaagactgcaggccatgaaaaacagcacaacctattgttatgatttcccactggtaagagatatcaaactcc

SEQ ID NO: 3486 - DNA, 200 bp, Kochia scoparia
ggagtttgatatctcttaccagtgggaaatcataacaataggttgtgctgtttttcatggcctgcagtcttttacgagcaatgactccaagtggttgatagggtgcattcactggtattccatgaagaggaccttgaacagatactgaatggtagatcatttcatgaaggttgttatcctccaactcacggtaaacctgc

SEQ ID NO: 3487 - DNA, 200 bp, Kochia scoparia
ccactggtaagagatatcaaactccactgtaccacaatactacaaaagcagaatttacagtattaggtttcctttcctccaaaaaaatcaagggttgatgcatgacttacattcgagtgtaactatggttcttgtttacgctcaactagtaatgaaataggaatataaatctaataaagatttacaaattttggagagag

SEQ ID NO: 3488 - DNA, 200 bp, Kochia scoparia
ctctctccaaaatttgtaaatctttattagatttatattcctatttcattactagttgagcgtaaacaagaaccatagttacactcgaatgtaagtcatgcatcaacccttgatttttttggaggaaaggaaacctaatactgtaaattctgcttttgtagtattgtggtacagtggagtttgatatctcttaccagtgg

SEQ ID NO: 3489 - DNA, 200 bp, Kochia scoparia
aaagatttacaaattttggagagaggcggggttgtgtaactgtgggactttgtaaaggtttaaagttagttaggtggagatgcagggtttatatttagtttatgaggaaactacaagttttcaagattttaataggtaatacgtgtaaaattttaaaagatatcggaatatttgtcttagtattttggattattgtaact

SEQ ID NO: 3490 - DNA, 200 bp, Kochia scoparia
agttacaataatccaaaatactaagacaaatattccgatatcttttaaaattttacacgtattacctattaaaatcttgaaaacttgtagtttcctcataaactaaatataaaccctgcatctccacctaactaactttaaacctttacaaagtcccacagttacacaaccccgcctctctccaaaatttgtaaatcttt

SEQ ID NO: 3491 - DNA, 200 bp, Kochia scoparia
cttagtattttggattattgtaactttgtaaataaaaatagtttcacattttgttaagatttcaagtttggctttcgcacacaatgggtctgttcttttcaccttatctgtacttatccgaacttttccgaacttctatgaacttgttttgtgagagagaaaaataataagtttgttcttttcaacttattttttattat

SEQ ID NO: 3492 - DNA, 200 bp, Kochia scoparia
ataataaaaaataagttgaaaagaacaaacttattatttttctctctcacaaaacaagttcatagaagttcggaaaagttcggataagtacagataaggtgaaaagaacagacccattgtgtgcgaaagccaaacttgaaatcttaacaaaatgtgaaactatttttatttacaaagttacaataatccaaaatactaag

SEQ ID NO: 3493 - DNA, 200 bp, Kochia scoparia
ttcttttcaacttattttttattatctgaacttatttgaatttattttttctgaaattaagtaaaaataagctcaatagaacatacccaatgtagaaaaatagaattaaacaaagaaatagtggggaaaaaaagtggaggtgatttgtgtctcttgtgggcattagtttagtaacagctagagtaatggatatagatgac

SEQ ID NO: 3494 - DNA, 200 bp, Kochia scoparia
gtcatctatatccattactctagctgttactaaactaatgcccacaagagacacaaatcacctccactttttttccccactatttctttgtttaattctatttttctacattgggtatgttctattgagcttatttttacttaatttcagaaaaaataaattcaaataagttcagataataaaaaataagttgaaaagaa

SEQ ID NO: 3495 - DNA, 200 bp, Kochia scoparia
agctagagtaatggatatagatgacttatttttaattcattgtatgacatacatcaaaaacctgaaattttagtgatatcaaattggccttaattagtaatttagttgtttgatattgttggttatacaagtgaaaacagatacttaatatgcgaatgattgtgcctatagtgattatgtgactgtgttgttaaatataa

SEQ ID NO: 3496 - DNA, 200 bp, Kochia scoparia
ttatatttaacaacacagtcacataatcactataggcacaatcattcgcatattaagtatctgttttcacttgtataaccaacaatatcaaacaactaaattactaattaaggccaatttgatatcactaaaatttcaggtttttgatgtatgtcatacaatgaattaaaaataagtcatctatatccattactctagct

SEQ ID NO: 3497 - DNA, 200 bp, Kochia scoparia
tatgtgactgtgttgttaaatataaaagtgtttcagtgtttttaagacaagggaagtagggaaccataaacaaaaatacgaagcatatcttgggtgttacctagttttgtcctatttctcaattattgatttagttgtttaatttgttggttataaaagagagaaaccgggattgttggtgtgcaaagattgtacctata

SEQ ID NO: 3498 - DNA, 200 bp, Kochia scoparia
tataggtacaatctttgcacaccaacaatcccggtttctctcttttataaccaacaaattaaacaactaaatcaataattgagaaataggacaaaactaggtaacacccaagatatgcttcgtatttttgtttatggttccctacttcccttgtcttaaaaacactgaaacacttttatatttaacaacacagtcacata

SEQ ID NO: 3499 - DNA, 200 bp, Kochia scoparia
ttggtgtgcaaagattgtacctatagtgattatgtgacaacgttgtcaaatgtaaaagcattgcaatttttgtgaggcaaaggaaccataaataaaaatgcgaagcatggcttgggtgttacctagctttgtcctatttattgaactatgtgattgtacctcaaatttttatatttgatgttgtatcgatcaacttgctt

SEQ ID NO: 3500 - DNA, 200 bp, Kochia scoparia
aagcaagttgatcgatacaacatcaaatataaaaatttgaggtacaatcacatagttcaataaataggacaaagctaggtaacacccaagccatgcttcgcatttttatttatggttcctttgcctcacaaaaattgcaatgcttttacatttgacaacgttgtcacataatcactataggtacaatctttgcacaccaa

SEQ ID NO: 3501 - DNA, 200 bp, Kochia scoparia
tgatgttgtatcgatcaacttgctttagctcacgttagcatttatctgtttttctattggaaaattgacctgaaattattgggaatgtttttctcaggctttctctactgccttagagcaatcatgggcatctcaagctccgcttctgaagaaacccgctaacaaaaaagttttgaaagtctcagagctagtatttgctg

SEQ ID NO: 3502 - DNA, 200 bp, Kochia scoparia
cagcaaatactagctctgagactttcaaaacttttttgttagcgggtttcttcagaagcggagcttgagatgcccatgattgctctaaggcagtagagaaagcctgagaaaaacattcccaataatttcaggtcaattttccaatagaaaaacagataaatgctaacgtgagctaaagcaagttgatcgatacaacatca

SEQ ID NO: 3503 - DNA, 200 bp, Kochia scoparia
aaagtctcagagctagtatttgctgattcaaatggcacctggggaacaccagttgtcccgacaaatcgtgaacctggtcttaacaatattggcatggttgcctggtccatggagatgtcaactcctgaattccctgatggaagaaccatattggttgtagcaaatgatatcaccttcatggctggatcatttgggccaaa

SEQ ID NO: 3504 - DNA, 200 bp, Kochia scoparia
tttggcccaaatgatccagccatgaaggtgatatcatttgctacaaccaatatggttcttccatcagggaattcaggagttgacatctccatggaccaggcaaccatgccaatattgttaagaccaggttcacgatttgtcgggacaactggtgttccccaggtgccatttgaatcagcaaatactagctctgagacttt

SEQ ID NO: 3505 - DNA, 200 bp, Kochia scoparia
tcatggctggatcatttgggccaaaagaagatgctctcttccaggcagttacagatcttgcttgttccaaaaaaattcctctgatttacctggctgctaattctggtgctcgactgggtgttgctgaagaggtaagagcatgctttaaaattggttggaccgatgagttgaaccctgagcgggggttccagtatatctac

SEQ ID NO: 3506 - DNA, 200 bp, Kochia scoparia
gtagatatactggaacccccgctcagggttcaactcatcggtccaaccaattttaaagcatgctcttacctcttcagcaacacccagtcgagcaccagaattagcagccaggtaaatcagaggaatttttttggaacaagcaagatctgtaactgcctggaagagagcatcttcttttggcccaaatgatccagccatga

SEQ ID NO: 3507 - DNA, 200 bp, Kochia scoparia
tgagcgggggttccagtatatctacttgactcctgaagattatgagcgtatagggtcagcagttatagcccatgagttagaactccaaaatggagagactcggtgggttatagacactgttgtagggaaggaggatgggataggtgttgagaacttatctggaagtggagctatagctggtgcctactcaagggcataca

SEQ ID NO: 3508 - DNA, 200 bp, Kochia scoparia
tgtatgcccttgagtaggcaccagctatagctccacttccagataagttctcaacacctatcccatcctccttccctacaacagtgtctataacccaccgagtctctccattttggagttctaactcatgggctataactgctgaccctatacgctcataatcttcaggagtcaagtagatatactggaacccccgctca

SEQ ID NO: 3509 - DNA, 200 bp, Kochia scoparia
gctggtgcctactcaagggcatacaaagaaacttttactctaacttttgtaacaggaagaacagtaggtattggtgcctatcttgctcgccttgggatgcgttgtatccaaaggcttgatcagcccattattctgacaggcttttctacgttaaataaacttcttggtcgtgaggtttacagctcacaaatgcaacttgg

SEQ ID NO: 3510 - DNA, 200 bp, Kochia scoparia
ccaagttgcatttgtgagctgtaaacctcacgaccaagaagtttatttaacgtagaaaagcctgtcagaataatgggctgatcaagcctttggatacaacgcatcccaaggcgagcaagataggcaccaatacctactgttcttcctgttacaaaagttagagtaaaagtttctttgtatgcccttgagtaggcaccagc

SEQ ID NO: 3511 - DNA, 200 bp, Kochia scoparia
tttacagctcacaaatgcaacttggcgggcccaagattatgggtacaaatggtgttgttcatttaacagtttcagatgaccttgaaggcatttcagctattgtcaagtggctcagctatgttccatcctactcaggaggtgaacttcctatttcacgttctttagatcctcctgaaagacaggttgattatttgcctgaa

SEQ ID NO: 3512 - DNA, 200 bp, Kochia scoparia
ttcaggcaaataatcaacctgtctttcaggaggatctaaagaacgtgaaataggaagttcacctcctgagtaggatggaacatagctgagccacttgacaatagctgaaatgccttcaaggtcatctgaaactgttaaatgaacaacaccatttgtacccataatcttgggcccgccaagttgcatttgtgagctgtaaa

SEQ ID NO: 3513 - DNA, 200 bp, Kochia scoparia
aagacaggttgattatttgcctgaaaattcttgtgatccccgttctgctatatctggtacacttgactctaatggcaattggcttggtggaatttttgacaaagatagttttgttgaaaccctagaaggctgggcaaggacagttatcactggccgggccaaacttggtggaatcccagttgggatagttgctgttgaga

SEQ ID NO: 3514 - DNA, 200 bp, Kochia scoparia
tctcaacagcaactatcccaactgggattccaccaagtttggcccggccagtgataactgtccttgcccagccttctagggtttcaacaaaactatctttgtcaaaaattccaccaagccaattgccattagagtcaagtgtaccagatatagcagaacggggatcacaagaattttcaggcaaataatcaacctgtctt

SEQ ID NO: 3515 - DNA, 200 bp, Kochia scoparia
ccagttgggatagttgctgttgagacacaaactgtgatgcaagttatcccagcagatcctggtcagcttgattcgcatgagcgagtggtcccacaagctggacaagtatggtttccagattctgcaactaagacagcacaagctttgatggattttaacagggaagaacttccacttttcattctagctaactggagagg

SEQ ID NO: 3516 - DNA, 200 bp, Kochia scoparia
cctctccagttagctagaatgaaaagtggaagttcttccctgttaaaatccatcaaagcttgtgctgtcttagttgcagaatctggaaaccatacttgtccagcttgtgggaccactcgctcatgcgaatcaagctgaccaggatctgctgggataacttgcatcacagtttgtgtctcaacagcaactatcccaactgg

SEQ ID NO: 3517 - DNA, 200 bp, Kochia scoparia
ttttcattctagctaactggagaggcttctctggagggcaaagggatctctttgaagggattcttcaggcagggtccacaattgtcgagaaccttaggacttataatcaacctgtttttgtttatatccccatgatgggtgaacttcgtggtggggcatgggttgtcgtagacagtaaaatcaattcggaccatattgag

SEQ ID NO: 3518 - DNA, 200 bp, Kochia scoparia
ctcaatatggtccgaattgattttactgtctacgacaacccatgccccaccacgaagttcacccatcatggggatataaacaaaaacaggttgattataagtcctaaggttctcgacaattgtggaccctgcctgaagaatcccttcaaagagatccctttgccctccagagaagcctctccagttagctagaatgaaaa

SEQ ID NO: 3519 - DNA, 200 bp, Kochia scoparia
taaaatcaattcggaccatattgagatgtatgctgatcagacagctaaaggaaatgttcttgagccagaaggaacgattgagatcaagtttagaaacaaggaattaattgaatgtatggaaaggcttgatcaacatctcatcaatcttaacgcaaaactcgtcgaagccaaaaactccaatttatatgttaatatcgaac

SEQ ID NO: 3520 - DNA, 200 bp, Kochia scoparia
gttcgatattaacatataaattggagtttttggcttcgacgagttttgcgttaagattgatgagatgttgatcaagcctttccatacattcaattaattccttgtttctaaacttgatctcaatcgttccttctggctcaagaacatttcctttagctgtctgatcagcatacatctcaatatggtccgaattgatttta

SEQ ID NO: 3521 - DNA, 200 bp, Kochia scoparia
tccaatttatatgttaatatcgaactcctgaaacagcagatagaagctcggcagaagcaacttttgcctctatatactcaaatagccacaaaatttgctgaattgcatgatagtccttatagaatggctgcgaaaggagtcgtcaaggaagtcctggattggagcaattctcgcttattcttccacaaaagactgtacag

SEQ ID NO: 3522 - DNA, 200 bp, Kochia scoparia
ctgtacagtcttttgtggaagaataagcgagaattgctccaatccaggacttccttgacgactcctttcgcagccattctataaggactatcatgcaattcagcaaattttgtggctatttgagtatatagaggcaaaagttgcttctgccgagcttctatctgctgtttcaggagttcgatattaacatataaattgga

SEQ ID NO: 3523 - DNA, 200 bp, Kochia scoparia
tattcttccacaaaagactgtacaggagagttatggaggaatcacttgtcaagaccgtccgagatgctgctggtgaagcaatgacccacaagtctgccatggaattgatcaagcaatggtttgctcagtctgatagtactagtggagtgggagctgatccttggtctgatgatgaagctttcttcaagtggaaagaaaat

SEQ ID NO: 3524 - DNA, 200 bp, Kochia scoparia
attttctttccacttgaagaaagcttcatcatcagaccaaggatcagctcccactccactagtactatcagactgagcaaaccattgcttgatcaattccatggcagacttgtgggtcattgcttcaccagcagcatctcggacggtcttgacaagtgattcctccataactctcctgtacagtcttttgtggaagaata

SEQ ID NO: 3525 - DNA, 200 bp, Kochia scoparia
agctttcttcaagtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtatctctaaggttcctccacacacacacacaccccaccc

SEQ ID NO: 3526 - DNA, 200 bp, Kochia scoparia
gggtggggtgtgtgtgtgtgtggaggaaccttagagataccttctgaagtagggcaacaagaccctgacgaagctgaagagctctcagatcagaagctgagttgtcaatatttgaaagctgatgcaatactttctgtatgcgtaactcaattagcttttcttcataattagcaggattttctttccacttgaagaaagct

SEQ ID NO: 3527 - DNA, 200 bp, Kochia scoparia
cagtctctgtttgaagagtatttgactgttgaagaattgttcagtgacaatatccaggtttgttattgcagttgcaaattcatcagtttttttggtcaaccaatttgtaccgggacaaattgccacagtcctaatttattgatgatcatcggtcttcgtgttttttttcccggtttggttgattggttatcatgttatga

SEQ ID NO: 3528 - DNA, 200 bp, Kochia scoparia
tcataacatgataaccaatcaaccaaaccgggaaaaaaaacacgaagaccgatgatcatcaataaattaggactgtggcaatttgtcccggtacaaattggttgaccaaaaaaactgatgaatttgcaactgcaataacaaacctggatattgtcactgaacaattcttcaacagtcaaatactcttcaaacagagactg

SEQ ID NO: 3529 - DNA, 200 bp, Kochia scoparia
tggttgattggttatcatgttatgaagttgtcacataaaaaaaacctaaatttactaatgcacccatttgaccctagaggctacagagtctttggagtactctgtctctgtggattatagtagcatcctttgaagtattactttattttttcaagaaattgtagttcatgtcttttgattctgatcttgaaaggaaggct

SEQ ID NO: 3530 - DNA, 200 bp, Kochia scoparia
agccttcctttcaagatcagaatcaaaagacatgaactacaatttcttgaaaaaataaagtaatacttcaaaggatgctactataatccacagagacagagtactccaaagactctgtagcctctagggtcaaatgggtgcattagtaaatttaggttttttttatgtgacaacttcataacatgataaccaatcaacca

SEQ ID NO: 3531 - DNA, 200 bp, Kochia scoparia
tgattctgatcttgaaaggaaggctgacatcattccactttattttctaatttcaatctatacaggctgatgtgattgaacgtctccgccttcaacataaaaaagacctgttaaaggttgttgacattgtcctatcacatcaggtaggcaggaaatttcaaataattcaaattaagtttgagttttcttttcccttttcc

SEQ ID NO: 3532 - DNA, 200 bp, Kochia scoparia
ggaaaagggaaaagaaaactcaaacttaatttgaattatttgaaatttcctgcctacctgatgtgataggacaatgtcaacaacctttaacaggtcttttttatgttgaaggcggagacgttcaatcacatcagcctgtatagattgaaattagaaaataaagtggaatgatgtcagccttcctttcaagatcagaatca

SEQ ID NO: 3533 - DNA, 200 bp, Kochia scoparia
gtttgagttttcttttcccttttcccttgtaatatcttccaggcttgtttactatgtagtaataatggctttcagggtgttaagaacaaaaataaattgattctccggctcatggaacaactggtttacccaaatcctgccgcataccgggagaagcttatccgtttttcacaactaaaccatacaatctactctgaggt

SEQ ID NO: 3534 - DNA, 200 bp, Kochia scoparia
acctcagagtagattgtatggtttagttgtgaaaaacggataagcttctcccggtatgcggcaggatttgggtaaaccagttgttccatgagccggagaatcaatttatttttgttcttaacaccctgaaagccattattactacatagtaaacaagcctggaagatattacaagggaaaagggaaaagaaaactcaaac

SEQ ID NO: 3535 - DNA, 200 bp, Kochia scoparia
taaaccatacaatctactctgaggttagtgattattcaattttttgtttatattgtcacactacagcattcacaaaaaggttattaagtttatacactaatcaattccttcactatatgcagttggcacttaaggcaagtcaattgcttgaacaaaccaagttgagtgaacttcgttctaatattgccagaaacctttcc

SEQ ID NO: 3536 - DNA, 200 bp, Kochia scoparia
ggaaaggtttctggcaatattagaacgaagttcactcaacttggtttgttcaagcaattgacttgccttaagtgccaactgcatatagtgaaggaattgattagtgtataaacttaataacctttttgtgaatgctgtagtgtgacaatataaacaaaaaattgaataatcactaacctcagagtagattgtatggttta

SEQ ID NO: 3537 - DNA, 200 bp, Kochia scoparia
ttctaatattgccagaaacctttccgagttagaaatgtttacagaagatggtgaaaacatggacactccaaaaaggaaaagtgctattaatgagcgtatggaggctcttgtgaatactccgcttgctgttgaagatgcccttgttggcttgttcgatcacagcgatcatacgttacaaaggcgggttgttgagacttatg

SEQ ID NO: 3538 - DNA, 200 bp, Kochia scoparia
cataagtctcaacaacccgcctttgtaacgtatgatcgctgtgatcgaacaagccaacaagggcatcttcaacagcaagcggagtattcacaagagcctccatacgctcattaatagcacttttcctttttggagtgtccatgttttcaccatcttctgtaaacatttctaactcggaaaggtttctggcaatattagaa

SEQ ID NO: 3539 - DNA, 200 bp, Kochia scoparia
caaaggcgggttgttgagacttatgtccggagactttatcaagtaatatctaagttccaacagtaaactttaactatcatttaataatgttatgtcatataactctattttttgtgggtaatctcttttctcagccttatcttgtaaaaggaagtgtcaggatgcagtggcacagatctggcctcattgtttcttgggag

SEQ ID NO: 3540 - DNA, 200 bp, Kochia scoparia
ctcccaagaaacaatgaggccagatctgtgccactgcatcctgacacttccttttacaagataaggctgagaaaagagattacccacaaaaaatagagttatatgacataacattattaaatgatagttaaagtttactgttggaacttagatattacttgataaagtctccggacataagtctcaacaacccgcctttg

SEQ ID NO: 3541 - DNA, 200 bp, Kochia scoparia
atctggcctcattgtttcttgggagttcatggaggagcacattgaaagagcaaatgcctctaatgatctgtccatcaaccagccccttgttgagaaacacagtgagagaaaatggggagccatggtcatcataaaatctcttcagtttttgccaacagtgattactgctgcattaaaagagacaacacataattcagatg

SEQ ID NO: 3542 - DNA, 200 bp, Kochia scoparia
catctgaattatgtgttgtctcttttaatgcagcagtaatcactgttggcaaaaactgaagagattttatgatgaccatggctccccattttctctcactgtgtttctcaacaaggggctggttgatggacagatcattagaggcatttgctctttcaatgtgctcctccatgaactcccaagaaacaatgaggccagat

SEQ ID NO: 3543 - DNA, 200 bp, Kochia scoparia
aaagagacaacacataattcagatgaaacgattcccagaggctctttagaatcaatcagtcatggaaatatgttgcacattgcacttgtgggtgttaataaccagatgagcttgttgcaggataggtatagattctatttttatggtttaagcaagattttaaaatgtgaacattggactatccaattttatttatgttt

SEQ ID NO: 3544 - DNA, 200 bp, Kochia scoparia
aaacataaataaaattggatagtccaatgttcacattttaaaatcttgcttaaaccataaaaatagaatctatacctatcctgcaacaagctcatctggttattaacacccacaagtgcaatgtgcaacatatttccatgactgattgattctaaagagcctctgggaatcgtttcatctgaattatgtgttgtctcttt

SEQ ID NO: 3545 - DNA, 200 bp, Kochia scoparia
ggactatccaattttatttatgtttatttatttatttatttttttgacgaggactatccagtttttttgaagaaatatgctttgcttcaattatgcagtcgctctttatagtaaccattccggccttttgcttaacctttttttctctgtggggtttatgaaatggaattttatactatgcagtggtgatgaagatcaag

SEQ ID NO: 3546 - DNA, 200 bp, Kochia scoparia
cttgatcttcatcaccactgcatagtataaaattccatttcataaaccccacagagaaaaaaaggttaagcaaaaggccggaatggttactataaagagcgactgcataattgaagcaaagcatatttcttcaaaaaaactggatagtcctcgtcaaaaaaataaataaataaataaacataaataaaattggatagtcc

SEQ ID NO: 3547 - DNA, 200 bp, Kochia scoparia
ctatgcagtggtgatgaagatcaagctcaagagagaattgataagttggcaaaaatcctgagagagaaagaagtgagctcaggtcttcgtgacgttggtgtcagggtaattagttgcattatacagagagatgaaggaagaacgccaatgaggcattcattctattggtcagaagagaaacaatacttcaatgaagagcc

SEQ ID NO: 3548 - DNA, 200 bp, Kochia scoparia
ggctcttcattgaagtattgtttctcttctgaccaatagaatgaatgcctcattggcgttcttccttcatctctctgtataatgcaactaattaccctgacaccaacgtcacgaagacctgagctcacttctttctctctcaggatttttgccaacttatcaattctctcttgagcttgatcttcatcaccactgcatag

SEQ ID NO: 3549 - DNA, 200 bp, Kochia scoparia
agaaacaatacttcaatgaagagcctttactacgtcatttggaacctcctctatcaatatatcttgaattggtatgatattctgagcaagaagctgttgtttttcttgtttattattttcttgtttcttaatatgggtcaaatcattatctttaacatttttgtcactatttgatatagttataaggtatttggctcaca

SEQ ID NO: 3550 - DNA, 200 bp, Kochia scoparia
tgtgagccaaataccttataactatatcaaatagtgacaaaaatgttaaagataatgatttgacccatattaagaaacaagaaaataataaacaagaaaaacaacagcttcttgctcagaatatcataccaattcaagatatattgatagaggaggttccaaatgacgtagtaaaggctcttcattgaagtattgtttct

SEQ ID NO: 3551 - DNA, 200 bp, Kochia scoparia
atagttataaggtatttggctcacaactttccttacacaggacaagctcaaggtctatgaaaatcccaaatatactccttctcgggatcgtcaatggcacctgtatactgtcatggacaagccatctattcgacgaatgtttttgaggacacttgtcagacagcccacttccgagttcagtggggttgaactaaaaattc

SEQ ID NO: 3552 - DNA, 200 bp, Kochia scoparia
gaatttttagttcaaccccactgaactcggaagtgggctgtctgacaagtgtcctcaaaaacattcgtcgaatagatggcttgtccatgacagtatacaggtgccattgacgatcccgagaaggagtatatttgggattttcatagaccttgagcttgtcctgtgtaaggaaagttgtgagccaaataccttataactat

SEQ ID NO: 3553 - DNA, 200 bp, Kochia scoparia
ttcagtggggttgaactaaaaattcttcaaacacaaaggcccatctcctttacttcaagaagcattctgaggtctttaacaactgcaatggaagaattagaactcaatgcgcacaatgctaccttgaaacctgatcatgctaatatgtacctgtacattgtaagagagcaacaaatacatgatcttgtcccatatcacag

SEQ ID NO: 3554 - DNA, 200 bp, Kochia scoparia
ctgtgatatgggacaagatcatgtatttgttgctctcttacaatgtacaggtacatattagcatgatcaggtttcaaggtagcattgtgcgcattgagttctaattcttccattgcagttgttaaagacctcagaatgcttcttgaagtaaaggagatgggcctttgtgtttgaagaatttttagttcaaccccactgaa

SEQ ID NO: 3555 - DNA, 200 bp, Kochia scoparia
tacatgatcttgtcccatatcacaggttctaattactattcttaattttatgtgtctcatttgtggttattgatgcaacttatgctttaagagggattattttgatccgttaatccagggaggtgaacattgatgacgaacaagaagagacagctgttcatatgtacttggaagagcttgcgcttgaaatccacagttgt

SEQ ID NO: 3556 - DNA, 200 bp, Kochia scoparia
acaactgtggatttcaagcgcaagctcttccaagtacatatgaacagctgtctcttcttgttcgtcatcaatgttcacctccctggattaacggatcaaaataatccctcttaaagcataagttgcatcaataaccacaaatgagacacataaaattaagaatagtaattagaacctgtgatatgggacaagatcatgta

SEQ ID NO: 3557 - DNA, 200 bp, Kochia scoparia
gcttgcgcttgaaatccacagttgtgctggtgtgagaatgcataaactaaatgtatgtgagtgggaagtaaaactttggatatcatcttctggtcaagccaatggttcatggagaatcattgttactaatgtgactggtcatacatgcactgtacatgtaagtttgaactatgatgattttttcctataattttctgtaa

SEQ ID NO: 3558 - DNA, 200 bp, Kochia scoparia
ttacagaaaattataggaaaaaatcatcatagttcaaacttacatgtacagtgcatgtatgaccagtcacattagtaacaatgattctccatgaaccattggcttgaccagaagatgatatccaaagttttacttcccactcacatacatttagtttatgcattctcacaccagcacaactgtggatttcaagcgcaagc

SEQ ID NO: 3559 - DNA, 200 bp, Kochia scoparia
gattttttcctataattttctgtaaaggtttttagtattggccgtgtttagtaatttctttcaacactcagatatttatgccagtttttgtaagaattacagaaatagtagcatgtttttagtgcccaagttctttctttgtccttttgcccagcaatatctttaataatttatggttataaactataagatattatgag

SEQ ID NO: 3560 - DNA, 200 bp, Kochia scoparia
ctcataatatcttatagtttataaccataaattattaaagatattgctgggcaaaaggacaaagaaagaacttgggcactaaaaacatgctactatttctgtaattcttacaaaaactggcataaatatctgagtgttgaaagaaattactaaacacggccaatactaaaaacctttacagaaaattataggaaaaaatc

SEQ ID NO: 3561 - DNA, 200 bp, Kochia scoparia
gttataaactataagatattatgagactatacatcgagaaaaatctaaatacatcttccattacaacctttgattttttttttttttttttttaaattgaaaaaacaatgggtaaaggtgatacatgaatcttgtaaaacacaaacaatgaccatacatatgggacggagggagtaataatggtttgtatattggcactt

SEQ ID NO: 3562 - DNA, 200 bp, Kochia scoparia
aagtgccaatatacaaaccattattactccctccgtcccatatgtatggtcattgtttgtgttttacaagattcatgtatcacctttacccattgttttttcaatttaaaaaaaaaaaaaaaaaaaatcaaaggttgtaatggaagatgtatttagatttttctcgatgtatagtctcataatatcttatagtttataac

SEQ ID NO: 3563 - DNA, 200 bp, Kochia scoparia
aataatggtttgtatattggcacttataaagaaaaaggttatgcacgattaatttatgtcttgtagacgtgtatcacataatgtcttctttagtttgctgacctttttctactaatgttatgcaggtttaccgtgagttggaggataacaaccttcatgaaatgatctaccattcagtatctgttcaaggtcctcttcat

SEQ ID NO: 3564 - DNA, 200 bp, Kochia scoparia
atgaagaggaccttgaacagatactgaatggtagatcatttcatgaaggttgttatcctccaactcacggtaaacctgcataacattagtagaaaaaggtcagcaaactaaagaagacattatgtgatacacgtctacaagacataaattaatcgtgcataacctttttctttataagtgccaatatacaaaccattatt

SEQ ID NO: 3565 - DNA, 200 bp, Kochia scoparia
agtatctgttcaaggtcctcttcatggaataccagtgaatgcaccctatcaaccacttggagtcattgctcgtaaaagactgcaggccatgaaaaacagcacaacctattgttatgatttcccactggtaagagatatcaaactccactgtaccacaatactacaaaagcagaatttacagtattaggtttcctttcctc

SEQ ID NO: 3566 - DNA, 200 bp, Kochia scoparia
gaggaaaggaaacctaatactgtaaattctgcttttgtagtattgtggtacagtggagtttgatatctcttaccagtgggaaatcataacaataggttgtgctgtttttcatggcctgcagtcttttacgagcaatgactccaagtggttgatagggtgcattcactggtattccatgaagaggaccttgaacagatact

SEQ ID NO: 3567 - DNA, 200 bp, Kochia scoparia
ttacagtattaggtttcctttcctccaaaaaaatcaagggttgatgcatgacttacattcgagtgtaactatggttcttgtttacgctcaactagtaatgaaataggaatataaatctaataaagatttacaaattttggagagaggcggggttgtgtaactgtgggactttgtaaaggtttaaagttagttaggtggag

SEQ ID NO: 3568 - DNA, 200 bp, Kochia scoparia
ctccacctaactaactttaaacctttacaaagtcccacagttacacaaccccgcctctctccaaaatttgtaaatctttattagatttatattcctatttcattactagttgagcgtaaacaagaaccatagttacactcgaatgtaagtcatgcatcaacccttgatttttttggaggaaaggaaacctaatactgtaa

SEQ ID NO: 3569 - DNA, 200 bp, Kochia scoparia
aaggtttaaagttagttaggtggagatgcagggtttatatttagtttatgaggaaactacaagtttacaagattttaataggtaatacgtgtaaaattttaaaagatatcggaaaagttgctagaataaaggaagtttagctaactttaaagaatatttgtcttagtattttggattattgtaactttgtaaataaaaat

SEQ ID NO: 3570 - DNA, 200 bp, Kochia scoparia
atttttatttacaaagttacaataatccaaaatactaagacaaatattctttaaagttagctaaacttcctttattctagcaacttttccgatatcttttaaaattttacacgtattacctattaaaatcttgtaaacttgtagtttcctcataaactaaatataaaccctgcatctccacctaactaactttaaacctt

SEQ ID NO: 3571 - DNA, 200 bp, Kochia scoparia
ttattgtaactttgtaaataaaaatagtttcacattttgttaagatttcaagtttggctttcgcacacaatgggtctgttcttttcaccttatctgtacttatccgaacttttccgaacttctatgaacttgttttgtgagagagaaaaataataagtttgttcttttcaacttattttttattatctgaacttatttga

SEQ ID NO: 3572 - DNA, 200 bp, Kochia scoparia
tcaaataagttcagataataaaaaataagttgaaaagaacaaacttattatttttctctctcacaaaacaagttcatagaagttcggaaaagttcggataagtacagataaggtgaaaagaacagacccattgtgtgcgaaagccaaacttgaaatcttaacaaaatgtgaaactatttttatttacaaagttacaataa

SEQ ID NO: 3573 - DNA, 200 bp, Kochia scoparia
ttttttattatctgaacttatttgaatttattttttctgaaattaagtaaaaataagctcaatagaacatacccaatgtagaaaaatagaattaaacaaagaaatagtggggaaaaaaagtggaggtgatttgtgtctcttgtgggcattagtttagtaacaactagagtaatggatatagatgacttatttttaattca

SEQ ID NO: 3574 - DNA, 200 bp, Kochia scoparia
tgaattaaaaataagtcatctatatccattactctagttgttactaaactaatgcccacaagagacacaaatcacctccactttttttccccactatttctttgtttaattctatttttctacattgggtatgttctattgagcttatttttacttaatttcagaaaaaataaattcaaataagttcagataataaaaaa

SEQ ID NO: 3575 - DNA, 200 bp, Kochia scoparia
atatagatgacttatttttaattcattgtatgacatacatcaaaaacctgaaattttagtgatatcaaattggccttaattagtaatttagttgtttgatattgttggttatacaagtgaaaacagatacttaatatgcgaatgattgtgcctatagtgattatgtgactgtgttgttaaatataaaagtgtttcagtgt

SEQ ID NO: 3576 - DNA, 200 bp, Kochia scoparia
acactgaaacacttttatatttaacaacacagtcacataatcactataggcacaatcattcgcatattaagtatctgttttcacttgtataaccaacaatatcaaacaactaaattactaattaaggccaatttgatatcactaaaatttcaggtttttgatgtatgtcatacaatgaattaaaaataagtcatctatat

SEQ ID NO: 3577 - DNA, 200 bp, Kochia scoparia
gttaaatataaaagtgtttcagtgtttttaagacaagggaagtagggaaccataaacaaaaatacgaagcatatcttgggtgttacctagttttgtcctatttctcaattattgatttagttgtttaatttgttggttataaaagagaaaaaccgggattgttggtgtgcaaagattgtacctatagtgattatgtgaca

SEQ ID NO: 3578 - DNA, 200 bp, Kochia scoparia
tgtcacataatcactataggtacaatctttgcacaccaacaatcccggtttttctcttttataaccaacaaattaaacaactaaatcaataattgagaaataggacaaaactaggtaacacccaagatatgcttcgtatttttgtttatggttccctacttcccttgtcttaaaaacactgaaacacttttatatttaac

SEQ ID NO: 3579 - DNA, 200 bp, Kochia scoparia
ttgtacctatagtgattatgtgacaacgttgtcaaatgtaaaagcattgcaatttttgtgaggcaaaggaaccataaataaaaatgcgaaacatggcttgggtgttacctagctttgtcctatttattgaactatgtgattgtacctcaaatttttatatttgatgttgtatcgatcaacttgctttagctcacgttagc

SEQ ID NO: 3580 - DNA, 200 bp, Kochia scoparia
gctaacgtgagctaaagcaagttgatcgatacaacatcaaatataaaaatttgaggtacaatcacatagttcaataaataggacaaagctaggtaacacccaagccatgtttcgcatttttatttatggttcctttgcctcacaaaaattgcaatgcttttacatttgacaacgttgtcacataatcactataggtacaa

SEQ ID NO: 3581 - DNA, 200 bp, Kochia scoparia
tcaacttgctttagctcacgttagcatttatctgtttttctattggaaaattgacctgaaattattgggaatgtttttctcaggctttctctactgccttagagcaatcatgggcatctcaagctccgcttctgaagaaacccgttaacaaaaaagttttgaaagtctcagagctagtatttgctgattcaaatggcacc

SEQ ID NO: 3582 - DNA, 200 bp, Kochia scoparia
ggtgccatttgaatcagcaaatactagctctgagactttcaaaacttttttgttaacgggtttcttcagaagcggagcttgagatgcccatgattgctctaaggcagtagagaaagcctgagaaaaacattcccaataatttcaggtcaattttccaatagaaaaacagataaatgctaacgtgagctaaagcaagttga

SEQ ID NO: 3583 - DNA, 200 bp, Kochia scoparia
agtatttgctgattcaaatggcacctggggaacaccagttgtcccgacaaatcgtgaacctggtcttaacaatattggcatggttgcctggtccatggagatgtcaactcctgaattccctgatggaagaaccatattggttgtagcaaatgatatcaccttcatggctggatcatttgggccaaaagaagatgctctct

SEQ ID NO: 3584 - DNA, 200 bp, Kochia scoparia
agagagcatcttcttttggcccaaatgatccagccatgaaggtgatatcatttgctacaaccaatatggttcttccatcagggaattcaggagttgacatctccatggaccaggcaaccatgccaatattgttaagaccaggttcacgatttgtcgggacaactggtgttccccaggtgccatttgaatcagcaaatact

SEQ ID NO: 3585 - DNA, 200 bp, Kochia scoparia
tttgggccaaaagaagatgctctcttccaggcagttacagatcttgcttgttccaaaaaaattcctctgatttacctggctgctaattctggtgctcgactgggtgttgctgaagaggtaagagcatgctttaaaattggttggaccgatgagttgaaccctgagcgggggttccagtatatctacttgactcctgaaga

SEQ ID NO: 3586 - DNA, 200 bp, Kochia scoparia
tcttcaggagtcaagtagatatactggaacccccgctcagggttcaactcatcggtccaaccaattttaaagcatgctcttacctcttcagcaacacccagtcgagcaccagaattagcagccaggtaaatcagaggaatttttttggaacaagcaagatctgtaactgcctggaagagagcatcttcttttggcccaaa

SEQ ID NO: 3587 - DNA, 200 bp, Kochia scoparia
agtatatctacttgactcctgaagattatgagcgtatagggtcagcagttatagcccatgagttagaactccaaaatggagagactcggtgggttatagacactgttgtagggaaggaggatgggataggtgttgagaacttatctggaagtggagctatagctggtgcctactcaagggcatacaaagaaacttttact

SEQ ID NO: 3588 - DNA, 200 bp, Kochia scoparia
agtaaaagtttctttgtatgcccttgagtaggcaccagctatagctccacttccagataagttctcaacacctatcccatcctccttccctacaacagtgtctataacccaccgagtctctccattttggagttctaactcatgggctataactgctgaccctatacgctcataatcttcaggagtcaagtagatatact

SEQ ID NO: 3589 - DNA, 200 bp, Kochia scoparia
aagggcatacaaagaaacttttactctaacttttgtaacaggaagaacagtaggtattggtgcctatcttgctcgccttgggatgcgttgtatccaaaggcttgatcagcccattattctgacaggcttttctacgttaaataaacttcttggtcgtgaggtttacagctcacaaatgcaacttggcgggcccaagatta

SEQ ID NO: 3590 - DNA, 200 bp, Kochia scoparia
taatcttgggcccgccaagttgcatttgtgagctgtaaacctcacgaccaagaagtttatttaacgtagaaaagcctgtcagaataatgggctgatcaagcctttggatacaacgcatcccaaggcgagcaagataggcaccaatacctactgttcttcctgttacaaaagttagagtaaaagtttctttgtatgccctt

SEQ ID NO: 3591 - DNA, 200 bp, Kochia scoparia
atgcaacttggcgggcccaagattatgggtacaaatggtgttgttcatttaacagtttcagatgaccttgaaggcatttcagctattgtcaagtggctcagctatgttccatcctactcaggaggtgaacttcctatttcacgttctttagatcctcctgaaagacaggttgattatttgcctgaaaattcttgtgatcc

SEQ ID NO: 3592 - DNA, 200 bp, Kochia scoparia
ggatcacaagaattttcaggcaaataatcaacctgtctttcaggaggatctaaagaacgtgaaataggaagttcacctcctgagtaggatggaacatagctgagccacttgacaatagctgaaatgccttcaaggtcatctgaaactgttaaatgaacaacaccatttgtacccataatcttgggcccgccaagttgcat

SEQ ID NO: 3593 - DNA, 200 bp, Kochia scoparia
atttgcctgaaaattcttgtgatccccgttctgctatatctggtacacttgactctaatggcaattggcttggtggaatttttgacaaagatagttttgttgaaaccctagaaggctgggcaaggacagttatcactggccgggccaaacttggtggaatcccagttgggatagttgctgttgagacacaaactgtgatg

SEQ ID NO: 3594 - DNA, 200 bp, Kochia scoparia
catcacagtttgtgtctcaacagcaactatcccaactgggattccaccaagtttggcccggccagtgataactgtccttgcccagccttctagggtttcaacaaaactatctttgtcaaaaattccaccaagccaattgccattagagtcaagtgtaccagatatagcagaacggggatcacaagaattttcaggcaaat

SEQ ID NO: 3595 - DNA, 200 bp, Kochia scoparia
tgctgttgagacacaaactgtgatgcaagttatcccagcagatcctggtcagcttgattcgcatgagcgagtggtcccacaagctggacaagtatggtttccagattctgcaactaagacagcacaagctttgatggattttaacagggaagaacttccacttttcattctagctaactggagaggcttctctggagggc

SEQ ID NO: 3596 - DNA, 200 bp, Kochia scoparia
gccctccagagaagcctctccagttagctagaatgaaaagtggaagttcttccctgttaaaatccatcaaagcttgtgctgtcttagttgcagaatctggaaaccatacttgtccagcttgtgggaccactcgctcatgcgaatcaagctgaccaggatctgctgggataacttgcatcacagtttgtgtctcaacagca

SEQ ID NO: 3597 - DNA, 200 bp, Kochia scoparia
aactggagaggcttctctggagggcaaagggatctctttgaagggattcttcaggcagggtccacaattgtcgagaaccttaggacttataatcaacctgtttttgtttatatccccatgatgggtgaacttcgtggtggggcatgggttgtcgtagacagtaaaatcaattcggaccatattgagatgtatgctgatca

SEQ ID NO: 3598 - DNA, 200 bp, Kochia scoparia
tgatcagcatacatctcaatatggtccgaattgattttactgtctacgacaacccatgccccaccacgaagttcacccatcatggggatataaacaaaaacaggttgattataagtcctaaggttctcgacaattgtggaccctgcctgaagaatcccttcaaagagatccctttgccctccagagaagcctctccagtt

SEQ ID NO: 3599 - DNA, 200 bp, Kochia scoparia
accatattgagatgtatgctgatcagacagctaaaggaaatgttcttgagccagaaggaacgattgagatcaagtttagaaacaaggaattaattgaatgtatggaaaggcttgatcaacatctcatcaatcttaacgcaaaactcgtcgaagccaaaaactccaatttatatgttaatatcgaactcctgaaacagcag

SEQ ID NO: 3600 - DNA, 200 bp, Kochia scoparia
ctgctgtttcaggagttcgatattaacatataaattggagtttttggcttcgacgagttttgcgttaagattgatgagatgttgatcaagcctttccatacattcaattaattccttgtttctaaacttgatctcaatcgttccttctggctcaagaacatttcctttagctgtctgatcagcatacatctcaatatggt

SEQ ID NO: 3601 - DNA, 200 bp, Kochia scoparia
taatatcgaactcctgaaacagcagatagaagctcggcagaagcaacttttgcctctatatactcaaatagccacaaaatttgctgaattgcatgatagtccttatagaatggctgcgaaaggagtcgtcaaggaagtcctggattggagcaattctcgcttattcttccacaaaagactgtacaggagagttatggagg

SEQ ID NO: 3602 - DNA, 200 bp, Kochia scoparia
cctccataactctcctgtacagtcttttgtggaagaataagcgagaattgctccaatccaggacttccttgacgactcctttcgcagccattctataaggactatcatgcaattcagcaaattttgtggctatttgagtatatagaggcaaaagttgcttctgccgagcttctatctgctgtttcaggagttcgatatta

SEQ ID NO: 3603 - DNA, 200 bp, Kochia scoparia
agactgtacaggagagttatggaggaatcacttgtcaagaccgtccgagatgctgctggtgaagcaatgacccacaagtctgccatggaattgatcaagcaatggtttgctgagtctgatagtactagtggagtgggagctgatccttggtctgatgatgaagctttcttcaagtggaaagaaaatcctgctaattatga

SEQ ID NO: 3604 - DNA, 200 bp, Kochia scoparia
tcataattagcaggattttctttccacttgaagaaagcttcatcatcagaccaaggatcagctcccactccactagtactatcagactcagcaaaccattgcttgatcaattccatggcagacttgtgggtcattgcttcaccagcagcatctcggacggtcttgacaagtgattcctccataactctcctgtacagtct

SEQ ID NO: 3605 - DNA, 200 bp, Kochia scoparia
gatcttgattgatgttgaggatgacttgttctgacgttgttttcttgatgatcggcctgtaaaatgaaacaaagattgctacctcggaggttttcccgagtaaaacctctccgaagtttaagtcagttcaatgatcttgaatggattggtattttaggaatttaatgtgagtcgttttagaattagatacctgattttgt

SEQ ID NO: 3606 - DNA, 200 bp, Kochia scoparia
acaaaatcaggtatctaattctaaaacgactcacattaaattcctaaaataccaatccattcaagatcattgaactgacttaaacttcggagaggttttactcgggaaaacctccgaggtagcaatctttgtttcattttacaggccgatcatcaagaaaacaacgtcagaacaagtcatcctcaacatcaatcaagatc

SEQ ID NO: 3607 - DNA, 200 bp, Kochia scoparia
tttagaattagatacctgattttgtgtggagagcttggtatatataggcaatcgggtgacctactagcttatcagtcaagcgatgtaatccggcacctggtagcttgtcatcagtttgactgggcaattaatggtcaagcggtttgaaatgtgtttcttggaccttaaatatggctttggttataatgagctagatttag

SEQ ID NO: 3608 - DNA, 200 bp, Kochia scoparia
ctaaatctagctcattataaccaaagccatatttaaggtccaagaaacacatttcaaaccgcttgaccattaattgcccagtcaaactgatgacaagctaccaggtgccggattacatcgcttgactgataagctagtaggtcacccgattgcctatatataccaagctctccacacaaaatcaggtatctaattctaaa

SEQ ID NO: 3609 - DNA, 200 bp, Kochia scoparia
tttggttataatgagctagatttaggtttggaccttagttttatgggttaatactagaggcgatcaaaaaaacccggcccgacccaaaattttgtgggctttggtcacgacttttttttggcccgaatacccatacacaaactaaaatggctagtacaaaagtacaaatatacaaaagttgttcttactagaaaaagcta

SEQ ID NO: 3610 - DNA, 200 bp, Kochia scoparia
tagctttttctagtaagaacaacttttgtatatttgtacttttgtactagccattttagtttgtgtatgggtattcgggccaaaaaaaagtcgtgaccaaagcccacaaaattttgggtcgggccgggtttttttgatcgcctctagtattaacccataaaactaaggtccaaacctaaatctagctcattataaccaaa

SEQ ID NO: 3611 - DNA, 200 bp, Kochia scoparia
aagttgttcttactagaaaaagctagttattgaccatcaattatctcaagtccaaataaacttttataagcactagaagtaagttgtatgagaagtattgatcaataactcagcaaaatagtacttcgtatataattataaacaagaagtcaaatttggtggagtgtgattgaattgaaaaaattggtagaattcaatat

SEQ ID NO: 3612 - DNA, 200 bp, Kochia scoparia
atattgaattctaccaattttttcaattcaatcacactccaccaaatttgacttcttgtttataattatatacgaagtactattttgctgagttattgatcaatacttctcatacaacttacttctagtgcttataaaagtttatttggacttgagataattgatggtcaataactagctttttctagtaagaacaactt

SEQ ID NO: 3613 - DNA, 200 bp, Kochia scoparia
tgaaaaaattggtagaattcaatatgatacaacaaagaaaagctacatggtcatattaaaagttaaattttgcataacaagagtaaaagaaatgataaattgattgacacgatcaataaatcaccggataaattcgtcatttcttattatcagtccttcaaattataataaattccccaatcccccacctaccattatac

SEQ ID NO: 3614 - DNA, 200 bp, Kochia scoparia
gtataatggtaggtgggggattggggaatttattataatttgaaggactgataataagaaatgacgaatttatccggtgatttattgatcgtgtcaatcaatttatcatttcttttactcttgttatgcaaaatttaacttttaatatgaccatgtagcttttctttgttgtatcatattgaattctaccaattttttca

SEQ ID NO: 3615 - DNA, 200 bp, Kochia scoparia
cccaatcccccacctaccattatactcgtaagtttttaacaatgctggaacaaacagtgcaaatgtgtgatttaaaaatcggtgctatttgtttatacttcctcgttgcagtagcatcatcacacattcatactaaaatcaaaatcacattcatcataaatcataataataaataatagaataattatacaggtagctga

SEQ ID NO: 3616 - DNA, 200 bp, Kochia scoparia
tcagctacctgtataattattctattatttattattatgatttatgatgaatgtgattttgattttagtatgaatgtgtgatgatgctactgcaacgaggaagtataaacaaatagcaccgatttttaaatcacacatttgcactgtttgttccagcattgttaaaaacttacgagtataatggtaggtgggggattggg

SEQ ID NO: 3617 - DNA, 200 bp, Kochia scoparia
atagaataattatacaggtagctgaaaggtgggcagttgccacgtgcatccccaaataaatatgcagttaattgaatgagatggaatggaaggcattctctgcacctcaaaccaaaccaacccccttcttcccctctaacacttcttcaatgacttctcttccttcttcttattctcattatatatacattcacaagtag

SEQ ID NO: 3618 - DNA, 200 bp, Kochia scoparia
ctacttgtgaatgtatatataatgagaataagaagaaggaagagaagtcattgaagaagtgttagaggggaagaagggggttggtttggtttgaggtgcagagaatgccttccattccatctcattcaattaactgcatatttatttggggatgcacgtggcaactgcccacctttcagctacctgtataattattctat

SEQ ID NO: 3619 - DNA, 200 bp, Kochia scoparia
tcattatatatacattcacaagtagctgatcactactgttttcttttttttgttctgtctaaagtttgattcttttccatcaaagtttgcttttttatgcaataattcaaattgcccagatgctaatttagtggaatttcattgaaaggtttgtttttttctgctgaattatgtccctttgatttgatttgagtgttttt

SEQ ID NO: 3620 - DNA, 200 bp, Kochia scoparia
aaaaacactcaaatcaaatcaaagggacataattcagcagaaaaaaacaaacctttcaatgaaattccactaaattagcatctgggcaatttgaattattgcataaaaaagcaaactttgatggaaaagaatcaaactttagacagaacaaaaaaaagaaaacagtagtgatcagctacttgtgaatgtatatataatga

SEQ ID NO: 3621 - DNA, 200 bp, Kochia scoparia
cctttgatttgatttgagtgttttttaagtttatgatgaatcatacatgcccttttatttgagttgattttgggatttgtcttatgttggggttggtttttggttggtttttggttggttttttttggtagtgtgtagttgagctaattaagtgtagaatagtgtgaaataatatattggttgtattgggtattgcttac

SEQ ID NO: 3622 - DNA, 200 bp, Kochia scoparia
gtaagcaatacccaatacaaccaatatattatttcacactattctacacttaattagctcaactacacactaccaaaaaaaaccaaccaaaaaccaaccaaaaaccaaccccaacataagacaaatcccaaaatcaactcaaataaaagggcatgtatgattcatcataaacttaaaaaacactcaaatcaaatcaaagg

SEQ ID NO: 3623 - DNA, 200 bp, Kochia scoparia
attggttgtattgggtattgcttactagaaaatgtgattcattttggtagttagttggctttagttgactgactcttctaagttctaactatgattgattgattgataatacaggtatgtgtagtccaaattggacctcattttataattatcctcattttataattataatttgttttttttggcattggattgttgac

SEQ ID NO: 3624 - DNA, 200 bp, Kochia scoparia
gtcaacaatccaatgccaaaaaaaacaaattataattataaaatgaggataattataaaatgaggtccaatttggactacacatacctgtattatcaatcaatcaatcatagttagaacttagaagagtcagtcaactaaagccaactaactaccaaaatgaatcacattttctagtaagcaatacccaatacaaccaat

SEQ ID NO: 3625 - DNA, 200 bp, Kochia scoparia
ttttttttggcattggattgttgactcttgaattctacttcactacttgaattgcattggattttttctattagtatttagcttttatgccataataaaaacttctgcctttcattcagctggtatgttctatacttctattctttttttttttttatataaattaattctttctttctctgttaatgttgttgttgtgt

SEQ ID NO: 3626 - DNA, 200 bp, Kochia scoparia
acacaacaacaacattaacagagaaagaaagaattaatttatataaaaaaaaaaaaagaatagaagtatagaacataccagctgaatgaaaggcagaagtttttattatggcataaaagctaaatactaatagaaaaaatccaatgcaattcaagtagtgaagtagaattcaagagtcaacaatccaatgccaaaaaaaa

SEQ ID NO: 3627 - DNA, 200 bp, Kochia scoparia
ttctctgttaatgttgttgttgtgttggataatatgttaattacccaattaaagagctcaaatcttgaagtaatgtatgagtattgcttatgatagtagcttttgtgattcaaagcttgcatcattcattaattgactatttgttttgtgtaatacgaggttgttgtagcttgattgctttttgacaggtagaatatgct

SEQ ID NO: 3628 - DNA, 200 bp, Kochia scoparia
agcatattctacctgtcaaaaagcaatcaagctacaacaacctcgtattacacaaaacaaatagtcaattaatgaatgatgcaagctttgaatcacaaaagctactatcataagcaatactcatacattacttcaagatttgagctctttaattgggtaattaacatattatccaacacaacaacaacattaacagagaa

SEQ ID NO: 3629 - DNA, 200 bp, Kochia scoparia
tgctttttgacaggtagaatatgcttatcatgtgaaaattgggaatgttattcatgtgatttgatgttattaggatgctgaccagtgttttatgaggtgatactgattcaacttgttgatgtaacagttataggaaaatcgggcgtattttttgctgagggcggggcggtgtgttaactagggaagagccaaagatggca

SEQ ID NO: 3630 - DNA, 200 bp, Kochia scoparia
tgccatctttggctcttccctagttaacacaccgccccgccctcagcaaaaaatacgcccgattttcctataactgttacatcaacaagttgaatcagtatcacctcataaaacactggtcagcatcctaataacatcaaatcacatgaataacattcccaattttcacatgataagcatattctacctgtcaaaaagca

SEQ ID NO: 3631 - DNA, 200 bp, Kochia scoparia
aactagggaagagccaaagatggcaactctagtgcgaaacattgattaccttaatggaacaactctgttgaggaattctactacattacccgttgttgatgaattttgttatgctcttggagggaaaaagccgattcatagtattttgattgccaacaatggaatggcagctgttaaatttatcagaagtgttcggacat

SEQ ID NO: 3632 - DNA, 200 bp, Kochia scoparia
atgtccgaacacttctgataaatttaacagctgccattccattgttggcaatcaaaatactatgaatcggctttttccctccaagagcataacaaaattcatcaacaacgggtaatgtagtagaattcctcaacagagttgttccattaaggtaatcaatgtttcgcactagagttgccatctttggctcttccctagtt

SEQ ID NO: 3633 - DNA, 200 bp, Kochia scoparia
aaatttatcagaagtgttcggacatgggcttacgaaacttttggaacagagaaggctattgtattagtagcaatggctactccagaagacatgagaatcaacgctgaacacattcgaatggctgaccagtttgttgaggttcctggtgggactaacaacaacaactatgccaatgtacagctcattgttgaggtaaatcc

SEQ ID NO: 3634 - DNA, 200 bp, Kochia scoparia
ggatttacctcaacaatgagctgtacattggcatagttgttgttgttagtcccaccaggaacctcaacaaactggtcagccattcgaatgtgttcagcgttgattctcatgtcttctggagtagccattgctactaatacaatagccttctctgttccaaaagtttcgtaagcccatgtccgaacacttctgataaattt

SEQ ID NO: 3635 - DNA, 200 bp, Kochia scoparia
tacagctcattgttgaggtaaatcctgctttagtaacactgatcttccgtgttttctctgttagattacgaaatactcacattagccacagtgtatgagaaaagatatcacctgtcctgttggcctgttgatgttcatcattgatttcagaggataaaattttgttaaaaagacttcaatttattttcactgctctttca

SEQ ID NO: 3636 - DNA, 200 bp, Kochia scoparia
tgaaagagcagtgaaaataaattgaagtctttttaacaaaattttatcctctgaaatcaatgatgaacatcaacaggccaacaggacaggtgatatcttttctcatacactgtggctaatgtgagtatttcgtaatctaacagagaaaacacggaagatcagtgttactaaagcaggatttacctcaacaatgagctgta

SEQ ID NO: 3637 - DNA, 200 bp, Kochia scoparia
tcaatttattttcactgctctttcagatggcagaaattacacgcgtagatgcagtttggccaggttggggacatgcatctgagatccctgagcttccagatgcactaaccgcaaaggggattgaatttctagggcctccagctatatctatggctgctcttggagacaaaatcggttcatcattgattgctcaggccgca

SEQ ID NO: 3638 - DNA, 200 bp, Kochia scoparia
tgcggcctgagcaatcaatgatgaaccgattttgtctccaagagcagccatagatatagctggaggccctagaaattcaatcccctttgcggttagtgcatctggaagctcagggatctcagatgcatgtccccaacctggccaaactgcatctacgcgtgtaatttctgccatctgaaagagcagtgaaaataaattga

SEQ ID NO: 3639 - DNA, 200 bp, Kochia scoparia
ttcatcattgattgctcaggccgcagatgttccaactcttccatggagtggctctcatgtatgaattgattttcttatcgaccttcacaaactttctttttctcaaggagtttcctaatcagttttcttaaatttctatgctttaggtgaaagttcctgctgagagttgccttgatactattcctgatgatatatacaag

SEQ ID NO: 3640 - DNA, 200 bp, Kochia scoparia
cttgtatatatcatcaggaatagtatcaaggcaactctcagcaggaactttcacctaaagcatagaaatttaagaaaactgattaggaaactccttgagaaaaagaaagtttgtgaaggtcgataagaaaatcaattcatacatgagagccactccatggaagagttggaacatctgcggcctgagcaatcaatgatgaa

SEQ ID NO: 3641 - DNA, 200 bp, Kochia scoparia
tactattcctgatgatatatacaaggcagcctgtgtttttaccacagaggaagcaattgctagttgtcaggttgtcggttatccagctatgattaaagcatcttggggtggtggtgggaaaggaataagaaaggtgagctagttgtttgggataatgtggtcaagaaattaaagcaccatcttcatatatatctctattg

SEQ ID NO: 3642 - DNA, 200 bp, Kochia scoparia
caatagagatatatatgaagatggtgctttaatttcttgaccacattatcccaaacaactagctcacctttcttattcctttcccaccaccaccccaagatgctttaatcatagctggataaccgacaacctgacaactagcaattgcttcctctgtggtaaaaacacaggctgccttgtatatatcatcaggaatagta

SEQ ID NO: 3643 - DNA, 200 bp, Kochia scoparia
accatcttcatatatatctctattgcttatttatcaacattttcacagcttccatccttgaacatcctttaattagtcaattgtctataattatctactagtcttaaatgatggacaaatgcttcaaacttgttagttagctagagacctgttaatctgttatgctacttcaatttcaatcgttttcctttcaaaatatc

SEQ ID NO: 3644 - DNA, 200 bp, Kochia scoparia
gatattttgaaaggaaaacgattgaaattgaagtagcataacagattaacaggtctctagctaactaacaagtttgaagcatttgtccatcatttaagactagtagataattatagacaattgactaattaaaggatgttcaaggatggaagctgtgaaaatgttgataaataagcaatagagatatatatgaagatggt

SEQ ID NO: 3645 - DNA, 200 bp, Kochia scoparia
tcaatcgttttcctttcaaaatatcagaaagactcaatagttatgcatttttaggtacataatgatgatgaagtaagggcattgttcaagcaagtgcagggcgaagttcctggctcacccatatttataatgaaggtggcttcacaggttagatattctgcaaattggttctataatgaattatataagcactcagaagt

SEQ ID NO: 3646 - DNA, 200 bp, Kochia scoparia
acttctgagtgcttatataattcattatagaaccaatttgcagaatatctaacctgtgaagccaccttcattataaatatgggtgagccaggaacttcgccctgcacttgcttgaacaatgcccttacttcatcatcattatgtacctaaaaatgcataactattgagtctttctgatattttgaaaggaaaacgattga

SEQ ID NO: 3647 - DNA, 200 bp, Kochia scoparia
atgaattatataagcactcagaagttcacggcactcgtgatcttagaacttgtactatatgcaaaattctttgttttgacaagttgttatatgtgcttcattcagagtcgacacttggaagtacatctactttgtgatcaatatggcaatgtagcagctttgcatagccgtgattgcagtgtccaaaggcggcaccagaa

SEQ ID NO: 3648 - DNA, 200 bp, Kochia scoparia
ttctggtgccgcctttggacactgcaatcacggctatgcaaagctgctacattgccatattgatcacaaagtagatgtacttccaagtgtcgactctgaatgaagcacatataacaacttgtcaaaacaaagaattttgcatatagtacaagttctaagatcacgagtgccgtgaacttctgagtgcttatataattcat

SEQ ID NO: 3649 - DNA, 200 bp, Kochia scoparia
gcagtgtccaaaggcggcaccagaaggtgggtccctagtgtactatcaataaacttttaatcttcttgaccaatttagtattacttcgggtctaaagtatattttttcaaagaaaatcgttatgtctcattgtttttgaaggaatgtataaatattttgtccattgtattaattgatcagattattgaagagggtccaat

SEQ ID NO: 3650 - DNA, 200 bp, Kochia scoparia
attggaccctcttcaataatctgatcaattaatacaatggacaaaatatttatacattccttcaaaaacaatgagacataacgattttctttgaaaaaatatactttagacccgaagtaatactaaattggtcaagaagattaaaagtttattgatagtacactagggacccaccttctggtgccgcctttggacactgc

SEQ ID NO: 3651 - DNA, 200 bp, Kochia scoparia
atcagattattgaagagggtccaataactgtagctccaccagaaactgtgagaaaacttgagcaggcagctagaaggttagccaaatgtgtgaattatgttggagcagcaactgtagaatatctgttcagcatggaaactggcgagttttatttccttgagctaaaccctcggctacaggtttgaagaatacacttgcac

SEQ ID NO: 3652 - DNA, 200 bp, Kochia scoparia
gtgcaagtgtattcttcaaacctgtagccgagggtttagctcaaggaaataaaactcgccagtttccatgctgaacagatattctacagttgctgctccaacataattcacacatttggctaaccttctagctgcctgctcaagttttctcacagtttctggtggagctacagttattggaccctcttcaataatctgat

SEQ ID NO: 3653 - DNA, 200 bp, Kochia scoparia
acaggtttgaagaatacacttgcacattgtatattcgtattttccttaagaaaaatattttatgttgatatttatggtattgcaactcaatatcctctagatatatcgttttctaccgtacgtttgtggctcactttattatgacatgctttgttaaaaagccttgggatttcttagagtgagacatgtcacccttgctt

SEQ ID NO: 3654 - DNA, 200 bp, Kochia scoparia
aagcaagggtgacatgtctcactctaagaaatcccaaggctttttaacaaagcatgtcataataaagtgagccacaaacgtacggtagaaaacgatatatctagaggatattgagttgcaataccataaatatcaacataaaatatttttcttaaggaaaatacgaatatacaatgtgcaagtgtattcttcaaacctgt

SEQ ID NO: 3655 - DNA, 200 bp, Kochia scoparia
agagtgagacatgtcacccttgcttttcaacttctgtgaatcatgtcttatactccctccatttccttttgtttgtctgatttaaatcttgggtgttgacactattcataggtagagagattcctctaaatttataagataaaacttagctctgtggggccttgtttaattcattttgatgagtactttaatgatattaa

SEQ ID NO: 3656 - DNA, 200 bp, Kochia scoparia
ttaatatcattaaagtactcatcaaaatgaattaaacaaggccccacagagctaagttttatcttataaatttagaggaatctctctacctatgaatagtgtcaacacccaagatttaaatcagacaaacaaaaggaaatggagggagtataagacatgattcacagaagttgaaaagcaagggtgacatgtctcactct

SEQ ID NO: 3657 - DNA, 200 bp, Kochia scoparia
ttgatgagtactttaatgatattaaatttttagaatttatattcatatatagttaaagatttgttaaatgtttgctgcgacaaacatgtgataatgaaatgggtcagaagaatggaatggagggagtactgctaagaattatcaatcctatatgatcatatgatggatgaaaaaaaaaattcttatttgacttttctgac

SEQ ID NO: 3658 - DNA, 200 bp, Kochia scoparia
gtcagaaaagtcaaataagaattttttttttcatccatcatatgatcatataggattgataattcttagcagtactccctccattccattcttctgacccatttcattatcacatgtttgtcgcagcaaacatttaacaaatctttaactatatatgaatataaattctaaaaatttaatatcattaaagtactcatcaa

SEQ ID NO: 3659 - DNA, 200 bp, Kochia scoparia
aaaattcttatttgacttttctgacaatattgtatataatgtccatatgtgcaggttttattttaaaaaatttccagtattggaaatccagttaattttattggttatttatttaattccttcttttttcgcatttgatatatacaggtggagcatccagtaactgaatggattgctgaaattaaccttccagctgctca

SEQ ID NO: 3660 - DNA, 200 bp, Kochia scoparia
tgagcagctggaaggttaatttcagcaatccattcagttactggatgctccacctgtatatatcaaatgcgaaaaaagaaggaattaaataaataaccaataaaattaactggatttccaatactggaaattttttaaaataaaacctgcacatatggacattatatacaatattgtcagaaaagtcaaataagaatttt

SEQ ID NO: 3661 - DNA, 200 bp, Kochia scoparia
ctgaaattaaccttccagctgctcaggttgcagttggcatgggtattcctctttggcaaattccaggtagcttgcatgttccctttttttattatataacttatgtgcttcatcttgttcttgtgtatgagttggcttgcttttgcaatttcaaaatagaaattcggcgattctatggtaaggaacatggtggcggttat

SEQ ID NO: 3662 - DNA, 200 bp, Kochia scoparia
ataaccgccaccatgttccttaccatagaatcgccgaatttctattttgaaattgcaaaagcaagccaactcatacacaagaacaagatgaagcacataagttatataataaaaaaagggaacatgcaagctacctggaatttgccaaagaggaatacccatgccaactgcaacctgagcagctggaaggttaatttcag

SEQ ID NO: 3663 - DNA, 200 bp, Kochia scoparia
tggtaaggaacatggtggcggttatgatgcttggagaagaacatcagttgcagcgactccttttgattttgacaaggcacaatctgtgaaaccaaaaggtcactgtactgccgtacgtgtgacaagtgaggaccctgatgatggattcaagcccactagtgggaaagtacaggttaataatgctattgttttatagttca

SEQ ID NO: 3664 - DNA, 200 bp, Kochia scoparia
tgaactataaaacaatagcattattaacctgtactttcccactagtgggcttgaatccatcatcagggtcctcacttgtcacacgtacggcagtacagtgaccttttggtttcacagattgtgccttgtcaaaatcaaaaggagtcgctgcaactgatgttcttctccaagcatcataaccgccaccatgttccttacca

SEQ ID NO: 3665 - DNA, 200 bp, Kochia scoparia
aataatgctattgttttatagttcaaactattttctcaattgattgccttgtctgttttgtgattcatgtaaaattatttaattcattggtttcttttctaggagttgagtttcaaaagtaaaccaaatgtgtgggcctatttctctgttaaggtatgtctttattttttttaagctttacatcatcctttatggactca

SEQ ID NO: 3666 - DNA, 200 bp, Kochia scoparia
tgagtccataaaggatgatgtaaagcttaaaaaaaataaagacataccttaacagagaaataggcccacacatttggtttacttttgaaactcaactcctagaaaagaaaccaatgaattaaataattttacatgaatcacaaaacagacaaggcaatcaattgagaaaatagtttgaactataaaacaatagcattatt

SEQ ID NO: 3667 - DNA, 200 bp, Kochia scoparia
ctttacatcatcctttatggactcattcacgagcttaacaatggtcaacactgtcaattgcagtctgggggaggcattcatgaattctcagattctcaatttggtaagtttaaagcacattttaaagatgactagcaatgaaatgactattatagctgccttttaagaatgaagttcttcaacatcatagtattcattct

SEQ ID NO: 3668 - DNA, 200 bp, Kochia scoparia
agaatgaatactatgatgttgaagaacttcattcttaaaaggcagctataatagtcatttcattgctagtcatctttaaaatgtgctttaaacttaccaaattgagaatctgagaattcatgaatgcctcccccagactgcaattgacagtgttgaccattgttaagctcgtgaatgagtccataaaggatgatgtaaag

SEQ ID NO: 3669 - DNA, 200 bp, Kochia scoparia
tcttcaacatcatagtattcattctctaatttaagactgctgcaaatggattgagaactgtgctgttgtgcatgtgaaatgagatatattggtttttcatagtgtgtcattgtagacagtaaatgctcttgttaattgttgatgattggaattgggatttagcatgcttggtgtagttttctcttgcacaaacaagtctc

SEQ ID NO: 3670 - DNA, 200 bp, Kochia scoparia
gagacttgtttgtgcaagagaaaactacaccaagcatgctaaatcccaattccaatcatcaacaattaacaagagcatttactgtctacaatgacacactatgaaaaaccaatatatctcatttcacatgcacaacagcacagttctcaatccatttgcagcagtcttaaattagagaatgaatactatgatgttgaaga

SEQ ID NO: 3671 - DNA, 200 bp, Kochia scoparia
gttttctcttgcacaaacaagtctcacggagttgatgtgtcatgtttttgtcgattatttttggtttaaaacatcaaattttgttttcttttatttatagaaggctaatgttaattaatttgtttgtagggcatgtctttgcatttggtgaatcaagagggttggccatagcaaacatggttcatggcttaaaagaaatt

SEQ ID NO: 3672 - DNA, 200 bp, Kochia scoparia
aatttcttttaagccatgaaccatgtttgctatggccaaccctcttgattcaccaaatgcaaagacatgccctacaaacaaattaattaacattagccttctataaataaaagaaaacaaaatttgatgttttaaaccaaaaataatcgacaaaaacatgacacatcaactccgtgagacttgtttgtgcaagagaaaac

SEQ ID NO: 3673 - DNA, 200 bp, Kochia scoparia
catggttcatggcttaaaagaaattcaaattcatggagaaattcgcacgaatgttgattataccattgattttttaaaagtaaaccttatacattttaactttgtagattttaattgagcatgtggccttatccttttacataccctttccggctgattgaggaataggagtttcccgctataaccaatgcacacaatga

SEQ ID NO: 3674 - DNA, 200 bp, Kochia scoparia
tcattgtgtgcattggttatagcgggaaactcctattcctcaatcagccggaaagggtatgtaaaaggataaggccacatgctcaattaaaatctacaaagttaaaatgtataaggtttacttttaaaaaatcaatggtataatcaacattcgtgcgaatttctccatgaatttgaatttcttttaagccatgaaccatg

SEQ ID NO: 3675 - DNA, 200 bp, Kochia scoparia
ccgctataaccaatgcacacaatgatttcaaaatacaaggataaggattttgctgtaaaatgaaggttgtgcctttcatttatttttatttgttgatgcattgtgctgtaaaattaaggccttcattttcatttattttattattttaaattggaggtataccaccttcttctaattgaattttgcaattgttgcatgat

SEQ ID NO: 3676 - DNA, 200 bp, Kochia scoparia
atcatgcaacaattgcaaaattcaattagaagaaggtggtatacctccaatttaaaataataaaataaatgaaaatgaaggccttaattttacagcacaatgcatcaacaaataaaaataaatgaaaggcacaaccttcattttacagcaaaatccttatccttgtattttgaaatcattgtgtgcattggttatagcgg

SEQ ID NO: 3677 - DNA, 200 bp, Kochia scoparia
ttgaattttgcaattgttgcatgattttgcaattgttgcatgattatgctctacttttaaagattgaattttgcaatttgttgtgtgtggtgtatgtcaatcaattatataaagtagaatgctagagtgaaaataaatggtcagcagcactatagcagaaaaaaaaaacaaatataaggtgtcatataacacactcatta

SEQ ID NO: 3678 - DNA, 200 bp, Kochia scoparia
taatgagtgtgttatatgacaccttatatttgttttttttttctgctatagtgctgctgaccatttattttcactctagcattctactttatataattgattgacatacaccacacacaacaaattgcaaaattcaatctttaaaagtagagcataatcatgcaacaattgcaaaatcatgcaacaattgcaaaattcaa

SEQ ID NO: 3679 - DNA, 200 bp, Kochia scoparia
aaggtgtcatataacacactcattaactcaggactacaactttaccccaacttgttatcgatattacccatttgctacatctcatatgttcttacaattttttttattcgtcaaatttgtaagacaagaggccttgattgtgaatttcctgtcaataccctctcaattctaaaaaaaatatcatgactactagactatga

SEQ ID NO: 3680 - DNA, 200 bp, Kochia scoparia
tcatagtctagtagtcatgatattttttttagaattgagagggtattgacaggaaattcacaatcaaggcctcttgtcttacaaatttgacgaataaaaaaaattgtaagaacatatgagatgtagcaaatgggtaatatcgataacaagttggggtaaagttgtagtcctgagttaatgagtgtgttatatgacacctt

SEQ ID NO: 3681 - DNA, 200 bp, Kochia scoparia
aaatatcatgactactagactatgagagttttgttagatcttatcaagcataaaggattctattaaaaaaataaaattatactagcagttgctaccattggaatgttaatgtttatctttcttggagggttagtaataactttaatcaatgagagtgacccacaaagctttcatgattctttatataaatgattattgtt

SEQ ID NO: 3682 - DNA, 200 bp, Kochia scoparia
aacaataatcatttatataaagaatcatgaaagctttgtgggtcactctcattgattaaagttattactaaccctccaagaaagataaacattaacattccaatggtagcaactgctagtataattttatttttttaatagaatcctttatgcttgataagatctaacaaaactctcatagtctagtagtcatgatattt

SEQ ID NO: 3683 - DNA, 200 bp, Kochia scoparia
attctttatataaatgattattgttcccgctgtaaaattgttcccgttgtctcatttaattgtttaaaatggataagatttgattagttttactgttaatgatgtttgtgtttgattagttttagtattttgcttaattgttgagattaattgttgaattaatgtgggtgatgaactgtgcaaggaagtgcagtagcagc

SEQ ID NO: 3684 - DNA, 200 bp, Kochia scoparia
gctgctactgcacttccttgcacagttcatcacccacattaattcaacaattaatctcaacaattaagcaaaatactaaaactaatcaaacacaaacatcattaacagtaaaactaatcaaatcttatccattttaaacaattaaatgagacaacgggaacaattttacagcgggaacaataatcatttatataaagaat

SEQ ID NO: 3685 - DNA, 200 bp, Kochia scoparia
ctgtgcaaggaagtgcagtagcagcagctatgagaaatcagctacagtaggtccaaggaatgtaacagcagctgcaactgacctgggggcctgtgcaagctgttcaggttgtctggacttgtgcaggcatccccggggcttgtgtaggcaaggcagcagcaagtgcaacagcatcaggtcttgtaggacagtgtcgacac

SEQ ID NO: 3686 - DNA, 200 bp, Kochia scoparia
gtgtcgacactgtcctacaagacctgatgctgttgcacttgctgctgccttgcctacacaagccccggggatgcctgcacaagtccagacaacctgaacagcttgcacaggcccccaggtcagttgcagctgctgttacattccttggacctactgtagctgatttctcatagctgctgctactgcacttccttgcacag

SEQ ID NO: 3687 - DNA, 200 bp, Kochia scoparia
aggtcttgtaggacagtgtcgacaccgtttcggtacatgtaatttggctgttcaattgaatattatttggcatgaagaagatcatgagttacatgattatagaaaatgattgtcttccagtggagctaatcaaggtcctcctagatagcctcaagaaggaaaatgatgtatctcttgctttattgctttccgaatttccc

SEQ ID NO: 3688 - DNA, 200 bp, Kochia scoparia
gggaaattcggaaagcaataaagcaagagatacatcattttccttcttgaggctatctaggaggaccttgattagctccactggaagacaatcattttctataatcatgtaactcatgatcttcttcatgccaaataatattcaattgaacagccaaattacatgtaccgaaacggtgtcgacactgtcctacaagacct

SEQ ID NO: 3689 - DNA, 200 bp, Kochia scoparia
tgctttattgctttccgaatttcccatcttttactcggttgttgtgttttttgcccttataatcatgcccgtctcagaaaaactcacctgcagcttttaatttgggtgtctttggcatgctcattctttttttttcaaccgatttcaaattttttgatttatttactgtgttttattgcaacttgagtgatttgtattta

SEQ ID NO: 3690 - DNA, 200 bp, Kochia scoparia
taaatacaaatcactcaagttgcaataaaacacagtaaataaatcaaaaaatttgaaatcggttgaaaaaaaaagaatgagcatgccaaagacacccaaattaaaagctgcaggtgagtttttctgagacgggcatgattataagggcaaaaaacacaacaaccgagtaaaagatgggaaattcggaaagcaataaagca

SEQ ID NO: 3691 - DNA, 200 bp, Kochia scoparia
ttgcaacttgagtgatttgtatttacttatgattgttatagaatttttgttatggtttggtttttggcttatttattagcttgggtctgaaatttgatctttcatatggtcgggtttatgagttaattagggcgttttactttctagtaattattgagatgatttattttaaaagaattagtttgactatatggaagaag

SEQ ID NO: 3692 - DNA, 200 bp, Kochia scoparia
cttcttccatatagtcaaactaattcttttaaaataaatcatctcaataattactagaaagtaaaacgccctaattaactcataaacccgaccatatgaaagatcaaatttcagacccaagctaataaataagccaaaaaccaaaccataacaaaaattctataacaatcataagtaaatacaaatcactcaagttgcaa

SEQ ID NO: 3693 - DNA, 200 bp, Kochia scoparia
aattagtttgactatatggaagaagttttagttgtgaatgtaatatttgtttttttacaaatactttaaatttgcaattttacggttgtgtttaagaagagcagaaacagaagaaggaagtgggaaatcatagaccacttcaagagattggctattttgatttttgaatgagattttatggtgctattgttgctggttga

SEQ ID NO: 3694 - DNA, 200 bp, Kochia scoparia
tcaaccagcaacaatagcaccataaaatctcattcaaaaatcaaaatagccaatctcttgaagtggtctatgatttcccacttccttcttctgtttctgctcttcttaaacacaaccgtaaaattgcaaatttaaagtatttgtaaaaaaacaaatattacattcacaactaaaacttcttccatatagtcaaactaatt

SEQ ID NO: 3695 - DNA, 200 bp, Kochia scoparia
ttatggtgctattgttgctggttgattgttagaggatccttgcatttgagcgaaaacaaagcaatccaagtgtaaactcatgctaatttcatggtttaaagtttttcattgttgattttagatttcttagtcttagatatttgtttttggtattcattttttaggggaaggaatgtttatattcaattttcatcacatca

SEQ ID NO: 3696 - DNA, 200 bp, Kochia scoparia
tgatgtgatgaaaattgaatataaacattccttcccctaaaaaatgaataccaaaaacaaatatctaagactaagaaatctaaaatcaacaatgaaaaactttaaaccatgaaattagcatgagtttacacttggattgctttgttttcgctcaaatgcaaggatcctctaacaatcaaccagcaacaatagcaccataa

SEQ ID NO: 3697 - DNA, 200 bp, Kochia scoparia
tttatattcaattttcatcacatcaagaattaactatgatggagcagagcacacatgggcgagcagatgaggttggtttttatcattgataattgaatgcaactaacaggggcaaactaagtactcaactaactaattaggcaaagttacctatacgactataattggacccaattaaggttactagcttgctgcaattt

SEQ ID NO: 3698 - DNA, 200 bp, Kochia scoparia
aaattgcagcaagctagtaaccttaattgggtccaattatagtcgtataggtaactttgcctaattagttagttgagtacttagtttgcccctgttagttgcattcaattatcaatgataaaaaccaacctcatctgctcgcccatgtgtgctctgctccatcatagttaattcttgatgtgatgaaaattgaatataaa

SEQ ID NO: 3699 - DNA, 200 bp, Kochia scoparia
taaggttactagcttgctgcaattttaccagtttgctaagcaaaatattacatattgtatatatagttagaatttgtccttttgttcgaggaaagaaaaagtaagggatgaaaatttgagactttctattagcaatttcatttaaattccaaaaaaagggtctcatctattttttttataacttgttgctataaaatttg

SEQ ID NO: 3700 - DNA, 200 bp, Kochia scoparia
caaattttatagcaacaagttataaaaaaaatagatgagaccctttttttggaatttaaatgaaattgctaatagaaagtctcaaattttcatcccttactttttctttcctcgaacaaaaggacaaattctaactatatatacaatatgtaatattttgcttagcaaactggtaaaattgcagcaagctagtaacctta

SEQ ID NO: 3701 - DNA, 200 bp, Kochia scoparia
ttataacttgttgctataaaatttgcaatgtgattgattgattgttaatatgaatttgtaatatgttttaacaggattcctgtgtcatctgtggctcaaaggtacttgacattaagatcacagtaagttcatccaattattataattatcttatcacttttgatattttaattgtttctcaaggattattgagaaagttt

SEQ ID NO: 3702 - DNA, 200 bp, Kochia scoparia
aaactttctcaataatccttgagaaacaattaaaatatcaaaagtgataagataattataataattggatgaacttactgtgatcttaatgtcaagtacctttgagccacagatgacacaggaatcctgttaaaacatattacaaattcatattaacaatcaatcaatcacattgcaaattttatagcaacaagttataa

SEQ ID NO: 3703 - DNA, 200 bp, Kochia scoparia
gtgttcggacatgggcttatgaaaattttggaacagagaaggctattgtattagtagcaatggctactccagaagacatgagaatcaacgctgaacacattcgaattgctgacgagtttgttgaggttcctggtgggactaacaacaactatgccaatgtacaactcattgttgaggtaaatcctgctttagtaaaactg

SEQ ID NO: 3704 - DNA, 200 bp, Kochia scoparia
cagttttactaaagcaggatttacctcaacaatgagttgtacattggcatagttgttgttagtcccaccaggaacctcaacaaactcgtcagcaattcgaatgtgttcagcgttgattctcatgtcttctggagtagccattgctactaatacaatagccttctctgttccaaaattttcataagcccatgtccgaacac

SEQ ID NO: 3705 - DNA, 200 bp, Kochia scoparia
ggtaaatcctgctttagtaaaactgatcttccgtgtttttgcactaatgttgattataccattgatcttttaaacgtgagccttatacatgaattttccccctacattgttcactgttttttcaattagaagctaaatttgtctttgtttttcctttctccagtctttggattacagagataataaaattcatacgggtt

SEQ ID NO: 3706 - DNA, 200 bp, Kochia scoparia
aacccgtatgaattttattatctctgtaatccaaagactggagaaaggaaaaacaaagacaaatttagcttctaattgaaaaaacagtgaacaatgtagggggaaaattcatgtataaggctcacgtttaaaagatcaatggtataatcaacattagtgcaaaaacacggaagatcagttttactaaagcaggatttacc

SEQ ID NO: 3707 - DNA, 200 bp, Kochia scoparia
agagataataaaattcatacgggttggttagatagtagaattgcaatgagagtcagagcggaaaggcccccctggttcatctctgtggggggaggtgcactctacgtgtgtacaacttttctcttaaatttttttccttccaaaagcttgatgtgtcactttcgtttatttttataatgaataattttaaatgatttctt

SEQ ID NO: 3708 - DNA, 200 bp, Kochia scoparia
aagaaatcatttaaaattattcattataaaaataaacgaaagtgacacatcaagcttttggaaggaaaaaaatttaagagaaaagttgtacacacgtagagtgcacctccccccacagagatgaaccaggggggcctttccgctctgactctcattgcaattctactatctaaccaacccgtatgaattttattatctct

SEQ ID NO: 3709 - DNA, 200 bp, Kochia scoparia; identical to SEQ ID NO: 3493

SEQ ID NO: 3710 - DNA, 200 bp, Kochia scoparia; identical to SEQ ID NO: 3494

SEQ ID NO: 3711 - DNA, 200 bp, Kochia scoparia; identical to SEQ ID NO: 3495

SEQ ID NO: 3712 - DNA, 200 bp, Kochia scoparia; identical to SEQ ID NO: 3496

SEQ ID NO: 3713 - DNA, 200 bp, Kochia scoparia; identical to SEQ ID NO: 3497

SEQ ID NO: 3714 - DNA, 200 bp, Kochia scoparia; identical to SEQ ID NO: 3498

SEQ ID NO: 3715 - DNA, 200 bp, Kochia scoparia; identical to SEQ ID NO: 3499

SEQ ID NO: 3716 - DNA, 200 bp, Kochia scoparia; identical to SEQ ID NO: 3500

SEQ ID NO: 3717 - DNA, 200 bp, Kochia scoparia; identical to SEQ ID NO: 3501

SEQ ID NO: 3718 - DNA, 200 bp, Kochia scoparia; identical to SEQ ID NO: 3502

SEQ ID NO: 3719 - DNA, 200 bp, Kochia scoparia; identical to SEQ ID NO: 3503

SEQ ID NO: 3720 - DNA, 200 bp, Kochia scoparia; identical to SEQ ID NO: 3504

SEQ ID NO: 3721 - DNA, 200 bp, Kochia scoparia; identical to SEQ ID NO: 3505

SEQ ID NO: 3722 - DNA, 200 bp, Kochia scoparia; identical to SEQ ID NO: 3506

SEQ ID NO: 3723 - DNA, 200 bp, Kochia scoparia; identical to SEQ ID NO: 3507

SEQ ID NO: 3724 - DNA, 200 bp, Kochia scoparia; identical to SEQ ID NO: 3508

SEQ ID NO: 3725 - DNA, 200 bp, Kochia scoparia; identical to SEQ ID NO: 3509

SEQ ID NO: 3726 - DNA, 200 bp, Kochia scoparia; identical to SEQ ID NO: 3510

SEQ ID NO: 3727 - DNA, 200 bp, Kochia scoparia; identical to SEQ ID NO: 3511

SEQ ID NO: 3728 - DNA, 200 bp, Kochia scoparia; identical to SEQ ID NO: 3512

SEQ ID NO: 3729 - DNA, 200 bp, Kochia scoparia; identical to SEQ ID NO: 3513

SEQ ID NO: 3730 - DNA, 200 bp, Kochia scoparia; identical to SEQ ID NO: 3514

SEQ ID NO: 3731 - DNA, 200 bp, Kochia scoparia; identical to SEQ ID NO: 3515

SEQ ID NO: 3732 - DNA, 200 bp, Kochia scoparia; identical to SEQ ID NO: 3516

SEQ ID NO: 3733 - DNA, 200 bp, Kochia scoparia; identical to SEQ ID NO: 3517

SEQ ID NO: 3734 - DNA, 200 bp, Kochia scoparia; identical to SEQ ID NO: 3518

SEQ ID NO: 3735 - DNA, 200 bp, Kochia scoparia; identical to SEQ ID NO: 3519

SEQ ID NO: 3736 - DNA, 200 bp, Kochia scoparia; identical to SEQ ID NO: 3520

SEQ ID NO: 3737 - DNA, 200 bp, Kochia scoparia; identical to SEQ ID NO: 3521

SEQ ID NO: 3738 - DNA, 200 bp, Kochia scoparia; identical to SEQ ID NO: 3522

SEQ ID NO: 3739 - DNA, 200 bp, Kochia scoparia
tattcttccacaaaagactgtacaggagagttatggaggaatcacttgtcaagaccgtccgagatgctgctggtgaagcaatgacccacaagtctgccatggaattgatcaagcaatggcttgctgagtctgccatggatagtactactagagcgggagctgatgcttgggctgacgatgaagctttcttcaggtggaaa

SEQ ID NO: 3740 - DNA, 200 bp, Kochia scoparia
tttccacctgaagaaagcttcatcgtcagcccaagcatcagctcccgctctagtagtactatccatggcagactcagcaagccattgcttgatcaattccatggcagacttgtgggtcattgcttcaccagcagcatctcggacggtcttgacaagtgattcctccataactctcctgtacagtcttttgtggaagaata

SEQ ID NO: 3741 - DNA, 200 bp, Kochia scoparia
cgatgaagctttcttcaggtggaaagaaaatcctgctaattatgaagaaaagctaattgagttacgcatacagaaagtattgcatcagctttcaaatattgacaactcagcttctgatctgagagctcttcagcttcgtcagggtcttgttgccctacttcagaaggtatctctaaggttcctccacacacacacacacc

SEQ ID NO: 3742 - DNA, 200 bp, Kochia scoparia
ggtgtgtgtgtgtgtggaggaaccttagagataccttctgaagtagggcaacaagaccctgacgaagctgaagagctctcagatcagaagctgagttgtcaatatttgaaagctgatgcaatactttctgtatgcgtaactcaattagcttttcttcataattagcaggattttctttccacctgaagaaagcttcatcg

SEQ ID NO: 3743 - DNA, 200 bp, Kochia scoparia
aggttcctccacacacacacacaccccacccaccaaaaaaaacacacacacacacattcacaagaaaagtagaattgctagtgaaataacttcatcgtgttcaatgcaggtgaattcctcaagccgagcaaatctagtagagaaactcgagaaagtgctcaattgatttggtaatgatcctgcagaaaaacctcttggta

SEQ ID NO: 3744 - DNA, 200 bp, Kochia scoparia
taccaagaggtttttctgcaggatcattaccaaatcaattgagcactttctcgagtttctctactagatttgctcggcttgaggaattcacctgcattgaacacgatgaagttatttcactagcaattctacttttcttgtgaatgtgtgtgtgtgtgttttttttggtgggtggggtgtgtgtgtgtgtggaggaacct

SEQ ID NO: 3745 - DNA, 200 bp, Kochia scoparia
gatcctgcagaaaaacctcttggtatatggtggtatgcaaatgccatatctgaaagattgattaggcaagttgagacagagacaggcacagttgtaataatgggatctatcaaaccagaagacgttataactaagctcaaagatgatggtgattttgaccgtcttcgtctcaaaatcattcgtaagctcaaacaaaacgt

SEQ ID NO: 3746 - DNA, 200 bp, Kochia scoparia
acgttttgtttgagcttacgaatgattttgagacgaagacggtcaaaatcaccatcatctttgagcttagttataacgtcttctggtttgatagatcccattattacaactgtgcctgtctctgtctcaacttgcctaatcaatctttcagatatggcatttgcataccaccatataccaagaggtttttctgcaggatc

SEQ ID NO: 3747 - DNA, 200 bp, Kochia scoparia
tcattcgtaagctcaaacaaaacgtatttctttctccttttcatcttctactgtatattaaatggtttaaaatttgatcttgattaatgggtaatctttataattttatcttttttattataatacaagaatgatatgcatatttttattttgttattaattaccaaatgcacttcagtttacattgccggttttgaagt

SEQ ID NO: 3748 - DNA, 200 bp, Kochia scoparia
acttcaaaaccggcaatgtaaactgaagtgcatttggtaattaataacaaaataaaaatatgcatatcattcttgtattataataaaaaagataaaattataaagattacccattaatcaagatcaaattttaaaccatttaatatacagtagaagatgaaaaggagaaagaaatacgttttgtttgagcttacgaatga

SEQ ID NO: 3749 - DNA, 200 bp, Kochia scoparia
cagtttacattgccggttttgaagttttggaagcagaattggggttagaatgctagatattattgcttgttgatcatttattcagttacttacattgtttggttgaaatcggaattaaaagagcacaaattgtatggtttctaactcgacttcacaataagagtatagatgctcactgttgtgttgtgtgttttgttttt

SEQ ID NO: 3750 - DNA, 200 bp, Kochia scoparia
aaaaacaaaacacacaacacaacagtgagcatctatactcttattgtgaagtcgagttagaaaccatacaatttgtgctcttttaattccgatttcaaccaaacaatgtaagtaactgaataaatgatcaacaagcaataatatctagcattctaaccccaattctgcttccaaaacttcaaaaccggcaatgtaaactg

SEQ ID NO: 3751 - DNA, 200 bp, Kochia scoparia
ctgttgtgttgtgtgttttgtttttgttaagaaatattggttttgattgatgatgctccaagcctcgagtgagcgtgttgatgaaatagagtactgaattaaaggttatcattttatcgaatgtcagattaattgttaattgttgctcggagtcggagtttaaatgagaatcattttatcgaatgtcttaagttatcagg

SEQ ID NO: 3752 - DNA, 200 bp, Kochia scoparia
cctgataacttaagacattcgataaaatgattctcatttaaactccgactccgagcaacaattaacaattaatctgacattcgataaaatgataacctttaattcagtactctatttcatcaacacgctcactcgaggcttggagcatcatcaatcaaaaccaatatttcttaacaaaaacaaaacacacaacacaacag

SEQ ID NO: 3753 - DNA, 200 bp, Lolium multiflorum
agggcgtcctccaatgcgccattccttccaatggtcatttgacaagctatattatgaggaggagccgatgctccgccatgtggaacctcctctgtccacattccttgaattggacaaagtgaaattagaaggttacagtgacatgaaatacaatccatcgcgtgatcgccagtggcacatttacacactgaacagtgaag

SEQ ID NO: 3754 - DNA, 200 bp, Lolium multiflorum
cttcactgttcagtgtgtaaatgtgccactggcgatcacgcgatggattgtatttcatgtcactgtaaccttctaatttcactttgtccaattcaaggaatgtggacagaggaggttccacatggcggagcatcggctcctcctcataatatagcttgtcaaatgaccattggaaggaatggcgcattggaggacgccct

SEQ ID NO: 3755 - DNA, 200 bp, Lolium multiflorum
cacatttacacactgaacagtgaagatccaaaatcaaatgaccaaaggatattccttcgtacagttgttagacagccaagtttaaccaatgggtttttgtttggaagtatcgacaatgaagtaggccgttctcaggccacatcgtcattcacatctaacagcatacttagatcattgattgcagcgctagaagaaataga

SEQ ID NO: 3756 - DNA, 200 bp, Lolium multiflorum
tctatttcttctagcgctgcaatcaatgatctaagtatgctgttagatgtgaatgacgatgtggcctgagaacggcctacttcattgtcgatacttccaaacaaaaacccattggttaaacttggctgtctaacaactgtacgaaggaatatcctttggtcatttgattttggatcttcactgttcagtgtgtaaatgtg

SEQ ID NO: 3757 - DNA, 200 bp, Lolium multiflorum
cacttctaaagccacaagtagaggatcccattcgcaggcgatggggtgtaatggttgtaatcaagtctcttcagcttctgccaactgcaattgaagctgcattaaaggagacttcacattatggagcaggtgatgcaaatgtctccaatggtagtcctataagatctaataatagcaatatgctgcatattgctttggtt

SEQ ID NO: 3758 - DNA, 200 bp, Lolium multiflorum
aaccaaagcaatatgcagcatattgctattattagatcttataggactaccattggagacatttgcatcacctgctccataatgtgaagtctcctttaatgcagcttcaattgcagttggcagaagctgaagagacttgattacaaccattacaccccatcgcctgcgaatgggatcctctacttgtggctttagaagtg

SEQ ID NO: 3759 - DNA, 200 bp, Lolium multiflorum
caatatgctgcatattgctttggttggtatcagaaatcagatgagtactcttcaagacaggttcgtttacactctctactctttgcgattctttattcttgatgaaacacaaaatatcataagagtgattctatgaactggttctgaatttcatgaaatttttagttacaccctccactttgttttctctttttagtggt

SEQ ID NO: 3760 - DNA, 200 bp, Lolium multiflorum
accactaaaaagagaaaacaaagtggagggtgtaactaaaaatttcatgaaattcagaaccagttcatagaatcactcttatgatattttgtgtttcatcaagaataaagaatcgcaaagagtagagagtgtaaacgaacctgtcttgaagagtactcatctgatttctgataccaaccaaagcaatatgcagcatattg

SEQ ID NO: 3761 - DNA, 200 bp, Lolium multiflorum
cactttgttttctctttttagtggtgatgaggatcaagcacaagaaaggatcaacaaactttccaagattttgagggataccactataacatcacatctcaatggtgctggtgttaggactgtcagctgcattatccaaagagatgaagggcgtcctccaatgcgccattccttccaatggtcatttgacaagctatatt

SEQ ID NO: 3762 - DNA, 200 bp, Lolium multiflorum
aatatagcttgtcaaatgaccattggaaggaatggcgcattggaggacgcccttcatctctttggataatgcagctgacagtcctaacaccagcaccattgagatgtgatgttatagtggtatccctcaaaatcttggaaagtttgttgatcctttcttgtgcttgatcctcatcaccactaaaaagagaaaacaaagtg

SEQ ID NO: 3763 - DNA, 200 bp, Lolium multiflorum
caatggtcatttgacaagctatattatgaggaggagccgatgctccgccatgtggaacctcctctgtccacattccttgaattggtatgcagctttagttttggcttatgttctcttcaacaataccagtacctctaataacttatctgtaaatacaggacaaagtgaaattagaaggttacagtgacatgaaatacaat

SEQ ID NO: 3764 - DNA, 200 bp, Lolium multiflorum
attgtatttcatgtcactgtaaccttctaatttcactttgtcctgtatttacagataagttattagaggtactggtattgttgaagagaacataagccaaaactaaagctgcataccaattcaaggaatgtggacagaggaggttccacatggcggagcatcggctcctcctcataatatagcttgtcaaatgaccattg

SEQ ID NO: 3765 - DNA, 200 bp, Lolium multiflorum
aggttacagtgacatgaaatacaatccatcgcgtgatcgccagtggcacatttacacactgaacagtgaagatccaaaatcaaatgaccaaaggatattccttcgtacagttgttagacagccaagtttaaccaatgggtttttgtttggaagtatcgacaatgaagtaggccgttctcaggccacatcgtcattcacat

SEQ ID NO: 3766 - DNA, 200 bp, Lolium multiflorum
atgtgaatgacgatgtggcctgagaacggcctacttcattgtcgatacttccaaacaaaaacccattggttaaacttggctgtctaacaactgtacgaaggaatatcctttggtcatttgattttggatcttcactgttcagtgtgtaaatgtgccactggcgatcacgcgatggattgtatttcatgtcactgtaacct

SEQ ID NO: 3767 - DNA, 200 bp, Lolium multiflorum
tctcaggccacatcgtcattcacatctaacagcatacttagatcattgattgcagcgctagaagaaatagagttacatgctcataataaggccatgagttcatgccattcccacatgtatctgtgcatgttgagagaacaacggttgtctgatctaattccattttcaaggtcagtcaaaatatacttatgttctcaata

SEQ ID NO: 3768 - DNA, 200 bp, Lolium multiflorum
tattgagaacataagtatattttgactgaccttgaaaatggaattagatcagacaaccgttgttctctcaacatgcacagatacatgtgggaatggcatgaactcatggccttattatgagcatgtaactctatttcttctagcgctgcaatcaatgatctaagtatgctgttagatgtgaatgacgatgtggcctgaga

SEQ ID NO: 3769 - DNA, 200 bp, Lolium multiflorum
tcaaaatatacttatgttctcaataaaatacactgcattaaatgtgctcatatgatgctcacttggtttgtgcttctcatggtgttaggatgatgggtgaagttggtcaagatgaggaggcagcatgcacacttttgaagcatatggttatgaatatatatgaacatgttggtgtcaggatgcatcgcctttctgtgtgc

SEQ ID NO: 3770 - DNA, 200 bp, Lolium multiflorum
gcacacagaaaggcgatgcatcctgacaccaacatgttcatatatattcataaccatatgcttcaaaagtgtgcatgctgcctcctcatcttgaccaacttcacccatcatcctaacaccatgagaagcacaaaccaagtgagcatcatatgagcacatttaatgcagtgtattttattgagaacataagtatattttga

SEQ ID NO: 3771 - DNA, 200 bp, Lolium multiflorum
caggatgcatcgcctttctgtgtgccaatgggaagtgaagctatggttagattgtgatgggcaagccaatggtgcttggagagttgtcattaccaatataactgggcatacctgcactgttgatgtaagttaccttagcgattgctgtattgcactactatgtgaacaacagcatctacagttctgcatatcataaagaa

SEQ ID NO: 3772 - DNA, 200 bp, Lolium multiflorum
ttctttatgatatgcagaactgtagatgctgttgttcacatagtagtgcaatacagcaatcgctaaggtaacttacatcaacagtgcaggtatgcccagttatattggtaatgacaactctccaagcaccattggcttgcccatcacaatctaaccatagcttcacttcccattggcacacagaaaggcgatgcatcctg

SEQ ID NO: 3773 - DNA, 200 bp, Lolium multiflorum
ctacagttctgcatatcataaagaatgctacctctgatggccccatagatcatcatatatgattatattttagttagtaaatagaacatggtcatcatttccatcattcgtgtcatggacattctctcaactgatgcctttaaagggtctattaaagaccacttaaaaataattaagtactattttctctttattccaat

SEQ ID NO: 3774 - DNA, 200 bp, Lolium multiflorum
attggaataaagagaaaatagtacttaattatttttaagtggtctttaatagaccctttaaaggcatcagttgagagaatgtccatgacacgaatgatggaaatgatgaccatgttctatttactaactaaaatataatcatatatgatgatctatggggccatcagaggtagcattctttatgatatgcagaactgtag

SEQ ID NO: 3775 - DNA, 200 bp, Lolium multiflorum
agtactattttctctttattccaatactcttatatgctcacattcgtttgactttcagatttaccgagaagtagaagactccaatacgcatcagattttctaccgctctgccacacacacagctggtcctttgcatggcattgcattgcatgagccatacaaacgtttggctcctattgacatgaaacggtctgcggcta

SEQ ID NO: 3776 - DNA, 200 bp, Lolium multiflorum
tagccgcagaccgtttcatgtcaataggagccaaacgtttgtatggctcatgcaatgcaatgccatgcaaaggaccagctgtgtgtgtggcagagcggtagaaaatctgatgcgtattggagtcttctacttctcggtaaatctgaaagtcaaacgaatgtgagcatataagagtattggaataaagagaaaatagtact

SEQ ID NO: 3777 - DNA, 200 bp, Lolium multiflorum
attgacatgaaacggtctgcggctaggaaaaacgaaactacatactgctatgatttcccattggtgagttggttgcgtttgttaatttactttttatctaacattagttcgcatgattaacctgatcaactgagtttgctaataatactctgtccacaggcatttgaaacagcattgaagaaattgtggaaatctagtgc

SEQ ID NO: 3778 - DNA, 200 bp, Lolium multiflorum
gcactagatttccacaatttcttcaatgctgtttcaaatgcctgtggacagagtattattagcaaactcagttgatcaggttaatcatgcgaactaatgttagataaaaagtaaattaacaaacgcaaccaactcaccaatgggaaatcatagcagtatgtagtttcgtttttcctagccgcagaccgtttcatgtcaat

SEQ ID NO: 3779 - DNA, 200 bp, Lolium multiflorum
tgaagaaattgtggaaatctagtgcttcacatcttgcagaaactaaccagcataatcagcagtatgctgaagtgacagagcttttatttgctgattcaactggatcatggggtactcctttggttccagttgaacgttctccatgtgtcaatgatatcggcattgttgcttggaagatgaagctctccacgccagaattt

SEQ ID NO: 3780 - DNA, 200 bp, Lolium multiflorum
aaattctggcgtggagagcttcatcttccaagcaacaatgccgatatcattgacacatggagaacgttcaactggaaccaaaggagtaccccatgatccagttgaatcagcaaataaaagctctgtcacttcagcatactgctgattatgctggttagtttctgcaagatgtgaagcactagatttccacaatttcttca

SEQ ID NO: 3781 - DNA, 200 bp, Lolium multiflorum
gatgaagctctccacgccagaatttccaggcggccgggagattatagttgttgcaaatgacgtgacgtttaaagctgggtcttttggtcctagagaagatatattctttcatgctgctaccaatcttgcctgtgagaggaaaattcctctaatctacttgtcagcaactgctggtgctaggcttggtgtggcagaggaaa

SEQ ID NO: 3782 - DNA, 200 bp, Lolium multiflorum
tttcctctgccacaccaagcctagcaccagcagttgctgacaagtagattagaggaattttcctctcacaggcaagattggtagcagcatgaaagaatatatcttctctaggaccaaaagacccagctttaaacgtcacgtcatttgcaacaactataatctcccggccgcctggaaattctggcgtggagagcttcatc

SEQ ID NO: 3783 - DNA, 200 bp, Lolium multiflorum
gctaggcttggtgtggcagaggaaataaagtcgtgcttccatgttggatggtctgatgaccagagtcctgaacgtggttttcactacatttacctcactgaagaagactattcacgtctaagctcttcagttatagcccatgaactgaaactagacagcggagaaaccagatggattgttgataccattgttgggaaaga

SEQ ID NO: 3784 - DNA, 200 bp, Lolium multiflorum
tctttcccaacaatggtatcaacaatccatctggtttctccgctgtctagtttcagttcatgggctataactgaagagcttagacgtgaatagtcttcttcagtgaggtaaatgtagtgaaaaccacgttcaggactctggtcatcagaccatccaacatggaagcacgactttatttcctctgccacaccaagcctagc

SEQ ID NO: 3785 - DNA, 200 bp, Lolium multiflorum
ttgttgataccattgttgggaaagaggatggacttggttgtgagaatctgcatggtagtggtgccattgccagtgcctttgctaaggcatatagagagacctttactctgacatttgtgactggaaacgcagttggaattggggcttatcttgctcggctaggaatgcggtgtatacagcgacttgatcaatcaattctt

SEQ ID NO: 3786 - DNA, 200 bp, Lolium multiflorum
aagaattgattgatcaagtcgctgtatacaccgcattcctagccgagcaagataagccccaattccaactgcgtttccagtcacaaatgtcagagtaaaggtctctctatatgccttagcaaaggcactggcaatggcaccactaccatgcagattctcacaaccaagtccatcctctttcccaacaatggtatcaacaa

SEQ ID NO: 3787 - DNA, 200 bp, Lolium multiflorum
acagcgacttgatcaatcaattcttttaactggtttttctgccctgaacaaacttctggggcgcgaggtttatagctctcagatgcaactgggtggccccaaaattatgggtacaaatggagtcgtccatctgacagtgccagatgatcttgaaggtgtttctgctatcttgaaatggctcagctatgttcctgcctatg

SEQ ID NO: 3788 - DNA, 200 bp, Lolium multiflorum
cataggcaggaacatagctgagccatttcaagatagcagaaacaccttcaagatcatctggcactgtcagatggacgactccatttgtacccataattttggggccacccagttgcatctgagagctataaacctcgcgccccagaagtttgttcagggcagaaaaaccagttaaaagaattgattgatcaagtcgctgt

SEQ ID NO: 3789 - DNA, 200 bp, Lolium multiflorum
tggctcagctatgttcctgcctatgttggcggtcctcttcctattctgaagcctcttgatccaccagatagagctgtaacatatttcccagagaattcatgtgatgcccgtgcagccatctgtgggattcaggacactcaaggcaagtggttgggtggtatgtttgacagagaaagctttgtggaaacattagaaggatg

SEQ ID NO: 3790 - DNA, 200 bp, Lolium multiflorum
catccttctaatgtttccacaaagctttctctgtcaaacataccacccaaccacttgccttgagtgtcctgaatcccacagatggctgcacgggcatcacatgaattctctgggaaatatgttacagctctatctggtggatcaagaggcttcagaataggaagaggaccgccaacataggcaggaacatagctgagcca

SEQ ID NO: 3791 - DNA, 200 bp, Lolium multiflorum
gctttgtggaaacattagaaggatgggcaaaaactgttattactggaagggcaaagctgggtgggattccagttggcgtcatagcagtggaaacccagacaatgatgcaagtaatcccttctgaccctggtcagcttgattccgctgagcgtgtagtccctcaagcaggacaggtgtggttcccagattcggcctcaaaa

SEQ ID NO: 3792 - DNA, 200 bp, Lolium multiflorum
ttttgaggccgaatctgggaaccacacctgtcctgcttgagggactacacgctcagcggaatcaagctgaccagggtcagaagggattacttgcatcattgtctgggtttccactgctatgacgccaactggaatcccacccagctttgcccttccagtaataacagtttttgcccatccttctaatgtttccacaaagc

SEQ ID NO: 3793 - DNA, 200 bp, Lolium multiflorum
gtggttcccagattcggcctcaaaaacagcgcaggcgttgctggatttcaaccatgaagggctcccattgttcatacttgctaactggagaggcttctctggtgggcaaagggatctgtttgaaggaatccttcaggctggctctacaattgttgagaacctgaggacctacaagcagccagcttttgtgtacatcccaa

SEQ ID NO: 3794 - DNA, 200 bp, Lolium multiflorum
ttgggatgtacacaaaagctggctgcttgtaggtcctcaggttctcaacaattgtagagccagcctgaaggattccttcaaacagatccctttgcccaccagagaagcctctccagttagcaagtatgaacaatgggagcccttcatggttgaaatccagcaacgcctgcgctgtttttgaggccgaatctgggaaccac

SEQ ID NO: 3795 - DNA, 200 bp, Lolium multiflorum
cagccagcttttgtgtacatcccaaaggctggagagctgcgtggaggtgcatgggttgtggtggacagcaagatcaatcctgagcacattgagatgtatgcggagaggactgcaaagggaaatgtccttgagccagaagggctgattgagattaaatttaagccaaaagaagtggaagagagtatgataaggcttgaccc

SEQ ID NO: 3796 - DNA, 200 bp, Lolium multiflorum
gggtcaagccttatcatactctcttccacttcttttggcttaaatttaatctcaatcagcccttctggctcaaggacatttccctttgcagtcctctccgcatacatctcaatgtgctcaggattgatcttgctgtccaccacaacccatgcacctccacgcagctctccagcctttgggatgtacacaaaagctggctg

SEQ ID NO: 3797 - DNA, 200 bp, Lolium multiflorum
aagagagtatgataaggcttgaccctgagctggccagccttgattctagactcaaagaaatgaagaaagcaaatgctagcctgcaggaaacggaggccatcaacaggagcatcaacaaccggataaagaagctgatgcccatctatacgcaggttgccacacggtttgctgaattgcacgacacctcttccagaatgact

SEQ ID NO: 3798 - DNA, 200 bp, Lolium multiflorum
agtcattctggaagaggtgtcgtgcaattcagcaaaccgtgtggcaacctgcgtatagatgggcatcagcttctttatccggttgttgatgctcctgttgatggcctccgtttcctgcaggctagcatttgctttcttcatttctttgagtctagaatcaaggctggccagctcagggtcaagccttatcatactctctt

SEQ ID NO: 3799 - DNA, 200 bp, Lolium multiflorum
gcacgacacctcttccagaatgactgccaaaggtgtgatcagtaaggtggttgattgggaggagtctcggagcttcttctacaggaggttgcgaaggcgggtcgcggaggattcccttgcccaggaagttaaagaagccgctggtgagccgatgcctcacagagcagcactggagcgtatcaagcagtggtatctggcct

SEQ ID NO: 3800 - DNA, 200 bp, Lolium multiflorum
aggccagataccactgcttgatacgctccagtgctgctctgtgaggcatcggctcaccagcggcttctttaacttcctgggcaagggaatcctccgcgacccgccttcgcaacctcctgtagaagaagctccgagactcctcccaatcaaccaccttactgatcacacctttggcagtcattctggaagaggtgtcgtgc

SEQ ID NO: 3801 - DNA, 200 bp, Lolium multiflorum
cgtatcaagcagtggtatctggcctccaagggttccgaaggagacggtgagaagtggaacgatgacgaggctttcttcgcctggaaagacgatgccaagaactacgagaaccatcttcaggagttgaaggctgaaagagtatctagactgttctcggatcttgctgaaagctcggacgtgaaggccttgcccaacggtct

SEQ ID NO: 3802 - DNA, 200 bp, Lolium multiflorum
agaccgttgggcaaggccttcacgtccgagctttcagcaagatccgagaacagtctagatactctttcagccttcaactcctgaagatggttctcgtagttcttggcatcgtctttccaggcgaagaaagcctcgtcatcgttccacttctcaccgtctccttcggaacccttggaggccagataccactgcttgatacg

SEQ ID NO: 3803 - DNA, 200 bp, Lolium multiflorum
cgttattgatctaaaacgatgctctgccagggccaacagaactacatactgctacgattttcccttggcatttgaaactgcagtgacgaagtcatggtctaacattcctagaaacaaccaatgttatgttaaagcgacagagctggtgtttgctgacaagaatgggtcgtggggcactcctataattcctatgcagcgtg

SEQ ID NO: 3804 - DNA, 200 bp, Lolium multiflorum
cacgctgcataggaattataggagtgccccacgacccattcttgtcagcaaacaccagctctgtcgctttaacataacattggttgtttctaggaatgttagaccatgacttcgtcactgcagtttcaaatgccaagggaaaatcgtagcagtatgtagttctgttggccctggcagagcatcgttttagatcaataacg

SEQ ID NO: 3805 - DNA, 200 bp, Lolium multiflorum
actcctataattcctatgcagcgtgctgctgggctcaatgacatcggtatggtagcctggatcttggacatgtccactcccgaatttcccagtggcagacagattattgttgtcgcaaatgatattacttttagagctggatcatttggcccaagggaagatgcattttttgaagctgttaccaacctggcttgtgagag

SEQ ID NO: 3806 - DNA, 200 bp, Lolium multiflorum
ctctcacaagccaggttggtaacagcttcaaaaaatgcatcttcccttgggccaaatgatccagctctaaaagtaatatcatttgcgacaacaataatctgtctgccactgggaaattcgggagtggacatgtccaagatccaggctaccataccgatgtcattgagcccagcagcacgctgcataggaattataggagt

SEQ ID NO: 3807 - DNA, 200 bp, Lolium multiflorum
ctgttaccaacctggcttgtgagagaaagcttcctcttatctatttggctgcaaactctggtgctcggattggcattgccgatgaagttaaatctatcttccgtgttaaatggattgatgatagcaaccctgaacgtggatttgattacgtttatctgtctgaagaagactatggccgtattagctcttctgttatagcg

SEQ ID NO: 3808 - DNA, 200 bp, Lolium multiflorum
cgctataacagaagagctaatacggccatagtcttcttcagacagataaacgtaatcaaatccacgttcagggttgctatcatcaatccatttaacacggaagatagatttaacttcatcggcaatgccaatccgagcaccagagtttgcagccaaatagataagaggaagctttctctcacaagccaggttggtaacag

SEQ ID NO: 3809 - DNA, 200 bp, Lolium multiflorum
ctaataacttatctgtaaatacaggacaaagtgaaattagaaggttacagtgacatgaaatacaatccatcgcgtgatcgccagtggcacatttacacactgaacagtgaagatccaaaatcaaatgaccaaaggatattccttcgtacagttgttagacagccaagtttaaccaatgggtttttgtttggaagtatcga

SEQ ID NO: 3810 - DNA, 200 bp, Lolium multiflorum
tcgatacttccaaacaaaaacccattggttaaacttggctgtctaacaactgtacgaaggaatatcctttggtcatttgattttggatcttcactgttcagtgtgtaaatgtgccactggcgatcacgcgatggattgtatttcatgtcactgtaaccttctaatttcactttgtcctgtatttacagataagttattag

SEQ ID NO: 3811 - DNA, 200 bp, Lolium multiflorum
atgggtttttgtttggaagtatcgacaatgaagtaggccgttctcaggccacatcgtcattcacatctaacagcatacttagatcattgattgcagcgctagaagaaatagagttacatgctcataataaggccatgagttcacgccattcccacatgtatctgtgcatgttgagagaacaacggttgtctgatctaatt

SEQ ID NO: 3812 - DNA, 200 bp, Lolium multiflorum
aattagatcagacaaccgttgttctctcaacatgcacagatacatgtgggaatggcgtgaactcatggccttattatgagcatgtaactctatttcttctagcgctgcaatcaatgatctaagtatgctgttagatgtgaatgacgatgtggcctgagaacggcctacttcattgtcgatacttccaaacaaaaacccat

SEQ ID NO: 3813 - DNA, 200 bp, Lolium multiflorum
ctagttcttgactcgagaagaaggtctgcagccagcagcctcgttcgttaactcggcgagcaaaggaaacaaggtaaacacacgatcctggcaaacacttttctttcttctctgaattgaagtcgtcgatatcgtgatgtttcatcttcgttacaataagcttggatgacggggagggtacttgcgttggctaggcagtc

SEQ ID NO: 3814 - DNA, 200 bp, Lolium multiflorum
gactgcctagccaacgcaagtaccctccccgtcatccaagcttattgtaacgaagatgaaacatcacgatatcgacgacttcaattcagagaagaaagaaaagtgtttgccaggatcgtgtgtttaccttgtttcctttgctcgccgagttaacgaacgaggctgctggctgcagaccttcttctcgagtcaagaactag

SEQ ID NO: 3815 - DNA, 200 bp, Lolium multiflorum
gggtacttgcgttggctaggcagtcgtttcgacaaagctggtggtggtgtgtcaactccaaaagccaacctgcttttcgtttctggcaacaaccctcccctgttcaaaaaccttgtcctgtcaaatcccagcttgccgaaacgtcctactgctggcaccccttgtacctcttgttctaggtttgatcaaagttgatcttt

SEQ ID NO: 3816 - DNA, 200 bp, Lolium multiflorum
aaagatcaactttgatcaaacctagaacaagaggtacaaggggtgccagcagtaggacgtttcggcaagctgggatttgacaggacaaggtttttgaacaggggagggttgttgccagaaacgaaaagcaggttggcttttggagttgacacaccaccaccagctttgtcgaaacgactgcctagccaacgcaagtaccc

SEQ ID NO: 3817 - DNA, 200 bp, Lolium multiflorum
ctaggtttgatcaaagttgatctttgtcaaattttactagattttttttacatctatacaacatatttgtacagtacatgtgcataccgatcgatataattttgttggtgctcgcagagtttgactagcatgtagcaggagcagtgatttatgctactactacttattgtactccagtaggatctacaatagtactagta

SEQ ID NO: 3818 - DNA, 200 bp, Lolium multiflorum
tactagtactattgtagatcctactggagtacaataagtagtagtagcataaatcactgctcctgctacatgctagtcaaactctgcgagcaccaacaaaattatatcgatcggtatgcacatgtactgtacaaatatgttgtatagatgtaaaaaaaatctagtaaaatttgacaaagatcaactttgatcaaacctag

SEQ ID NO: 3819 - DNA, 200 bp, Lolium multiflorum
agtaggatctacaatagtactagtatcgtagtcgtcgaatttagtcagtggtagcaaacaccaaacagcgagcagagaacgtcgccttcgccgccgtgatgctgctgggttgggggtttagctcagctacctcccaactaattccatccttccccaaatcaaataaaaaagaaaagaaaataaataaaaccagtccaccc

SEQ ID NO: 3820 - DNA, 200 bp, Lolium multiflorum
gggtggactggttttatttattttcttttcttttttatttgatttggggaaggatggaattagttgggaggtagctgagctaaacccccaacccagcagcatcacggcggcgaaggcgacgttctctgctcgctgtttggtgtttgctaccactgactaaattcgacgactacgatactagtactattgtagatcctact

SEQ ID NO: 3821 - DNA, 200 bp, Lolium multiflorum
gaaaataaataaaaccagtccaccccacagtccaaatccaagtcccaagtcccaacccagctcctctcgctcacgccttccggcctccctctctaccccgtcccgtgttccggccccagccgagcgtcgcatggcggggccgccggtggcacggcagttataagccgcgcgcggccaaccatccagcgagagcacagcac

SEQ ID NO: 3822 - DNA, 200 bp, Lolium multiflorum
gtgctgtgctctcgctggatggttggccgcgcgcggcttataactgccgtgccaccggcggccccgccatgcgacgctcggctggggccggaacacgggacggggtagagagggaggccggaaggcgtgagcgagaggagctgggttgggacttgggacttggatttggactgtggggtggactggttttatttattttc

SEQ ID NO: 3823 - DNA, 200 bp, Lolium multiflorum
caaccatccagcgagagcacagcacagtagcatagctacctcgcagcacgccctccctccctgctagctactcctcctctgcagactgcagcgggtgggggagaggaggcgcgcatttaagcccggcctcctcacctgtcggcctgccgccgcgcccgacgccgaggccttcccttcccggatcttgatctgcccgcctt

SEQ ID NO: 3824 - DNA, 200 bp, Lolium multiflorum
aaggcgggcagatcaagatccgggaagggaaggcctcggcgtcgggcgcggcggcaggccgacaggtgaggaggccgggcttaaatgcgcgcctcctctcccccacccgctgcagtctgcagaggaggagtagctagcagggagggagggcgtgctgcgaggtagctatgctactgtgctgtgctctcgctggatggttg

SEQ ID NO: 3825 - DNA, 200 bp, Lolium multiflorum
tcccggatcttgatctgcccgccttcctcctcctcggcggcattccgtcgaacgggcggcgcgcgcctacggcagtacggtacctaccctgccttctctccccccatctcccctgctcgccgtgtacgcgccagcgttgggcaccccgcacaaatctaccacacaatttcgctctccccggctcagtcagtcgccgctgt

SEQ ID NO: 3826 - DNA, 200 bp, Lolium multiflorum
acagcggcgactgactgagccggggagagcgaaattgtgtggtagatttgtgcggggtgcccaacgctggcgcgtacacggcgagcaggggagatggggggagagaaggcagggtaggtaccgtactgccgtaggcgcgcgccgcccgttcgacggaatgccgccgaggaggaggaaggcgggcagatcaagatccggga

SEQ ID NO: 3827 - DNA, 200 bp, Lolium multiflorum
ccccggctcagtcagtcgccgctgtgcgtagatcgcttccacttcctgctgggcgctcctggacgttccgtcgagcggtttctgagattgggctgaggggatcataccggcttccttttctgtcctcttttctgttccgttgcgtgcaggaattgttgtctgctcccacgcctttgcttgctcacctattccgtggactc

SEQ ID NO: 3828 - DNA, 200 bp, Lolium multiflorum
gagtccacggaataggtgagcaagcaaaggcgtgggagcagacaacaattcctgcacgcaacggaacagaaaagaggacagaaaaggaagccggtatgatcccctcagcccaatctcagaaaccgctcgacggaacgtccaggagcgcccagcaggaagtggaagcgatctacgcacagcggcgactgactgagccgggg

SEQ ID NO: 3829 - DNA, 200 bp, Lolium multiflorum
gcttgctcacctattccgtggactcccctgtgatcacaacatactcagcatactttttcttcacatgcctaggataatgaaatcgcaatctatgtaccatcgctgtcgcgatttctgctggctgttgactactaattttaccccttcacttgtgtacttatcctcgtaccgctgcttgaggaatttcatatttggctgct

SEQ ID NO: 3830 - DNA, 200 bp, Lolium multiflorum
agcagccaaatatgaaattcctcaagcagcggtacgaggataagtacacaagtgaaggggtaaaattagtagtcaacagccagcagaaatcgcgacagcgatggtacatagattgcgatttcattatcctaggcatgtgaagaaaaagtatgctgagtatgttgtgatcacaggggagtccacggaataggtgagcaagc

SEQ ID NO: 3831 - DNA, 200 bp, Lolium multiflorum
ttgaggaatttcatatttggctgcttgaggaatttcataaatctggctagacactcttcatgtttttgttcttacatctagtagtagttcagaaagaggaagcacagacgagcaactgacgtatccgtgcaattgttcgctagtcagaatgacagaatcgacgtgctcatttatatacctgatgtaattgtgcgcttctc

SEQ ID NO: 3832 - DNA, 200 bp, Lolium multiflorum
gagaagcgcacaattacatcaggtatataaatgagcacgtcgattctgtcattctgactagcgaacaattgcacggatacgtcagttgctcgtctgtgcttcctctttctgaactactactagatgtaagaacaaaaacatgaagagtgtctagccagatttatgaaattcctcaagcagccaaatatgaaattcctcaa

SEQ ID NO: 3833 - DNA, 200 bp, Lolium multiflorum
tacctgatgtaattgtgcgcttctcctcaagccgtagcttgaggcgtttcattttgttcgtttgcgaaaagtttgatgaggaatttcatggtctggctacgtactcaccttgtttgtttgcatcattttagcatcaagttcagaaacaataaataccctacttgtgcaatcattcgctaacagaatcgacaatgctaacg

SEQ ID NO: 3834 - DNA, 200 bp, Lolium multiflorum
cgttagcattgtcgattctgttagcgaatgattgcacaagtagggtatttattgtttctgaacttgatgctaaaatgatgcaaacaaacaaggtgagtacgtagccagaccatgaaattcctcatcaaacttttcgcaaacgaacaaaatgaaacgcctcaagctacggcttgaggagaagcgcacaattacatcaggta

SEQ ID NO: 3835 - DNA, 200 bp, Lolium multiflorum
gctaacagaatcgacaatgctaacggtttttctgtccgttgcttgtccagcgctgaaggctagagggcggcgacaatggtggcggaaccggacaagacaaatgggacgcccaacaggatgtccagtaacaggcacctgtcctcgccgtccgtggtcgacgagttctgcaaggcgctcgggggcgattcgcccatccacag

SEQ ID NO: 3836 - DNA, 200 bp, Lolium multiflorum
ctgtggatgggcgaatcgcccccgagcgccttgcagaactcgtcgaccacggacggcgaggacaggtgcctgttactggacatcctgttgggcgtcccatttgtcttgtccggttccgccaccattgtcgccgccctctagccttcagcgctggacaagcaacggacagaaaaaccgttagcattgtcgattctgttagc

SEQ ID NO: 3837 - DNA, 200 bp, Lolium multiflorum
tcgggggcgattcgcccatccacagcgtcctggtcgccaacaatggaatggccgccgtcaagttcatgcgcagcatccgcacctgggccctcgagacgtttgggaccgagaaggccattctcctggtggccatggcaactccggaggacctcaggataaacgccgagcacataaggatcgccgaccagttcttggaagtc

SEQ ID NO: 3838 - DNA, 200 bp, Lolium multiflorum
gacttccaagaactggtcggcgatccttatgtgctcggcgtttatcctgaggtcctccggagttgccatggccaccaggagaatggccttctcggtcccaaacgtctcgagggcccaggtgcggatgctgcgcatgaacttgacggcggccattccattgttggcgaccaggacgctgtggatgggcgaatcgcccccga

SEQ ID NO: 3839 - DNA, 200 bp, Lolium multiflorum
gatcgccgaccagttcttggaagtccctggcggaacaaacaataacaattatgcgaatgtgcagctcattgtggaggttagcacgacgaccattctcccggtcctttttactagcttgttgatttagcgtatccatgtttcttgtgctggatatttgactagttacttaatgtttctaccttcactgtcacagatagcgg

SEQ ID NO: 3840 - DNA, 200 bp, Lolium multiflorum
ccgctatctgtgacagtgaaggtagaaacattaagtaactagtcaaatatccagcacaagaaacatggatacgctaaatcaacaagctagtaaaaaggaccgggagaatggtcgtcgtgctaacctccacaatgagctgcacattcgcataattgttattgtttgttccgccagggacttccaagaactggtcggcgatc

SEQ ID NO: 3841 - DNA, 200 bp, Lolium multiflorum
ctaccttcactgtcacagatagcggagagaactcgggtttctgcggtttggcctggctggggccatgcttctgagaacccggaacttccagacgcgctcaaggagaagggaatcatttttcttgggccaccatcagccgcgatggctgcacttggtgataagattggttcttctcttattgcgcaagcagcaggagttcc

SEQ ID NO: 3842 - DNA, 200 bp, Lolium multiflorum
ggaactcctgctgcttgcgcaataagagaagaaccaatcttatcaccaagtgcagccatcgcggctgatggtggcccaagaaaaatgattcccttctccttgagcgcgtctggaagttccgggttctcagaagcatggccccagccaggccaaaccgcagaaacccgagttctctccgctatctgtgacagtgaaggtag

SEQ ID NO: 3843 - DNA, 200 bp, Lolium multiflorum
ttattgcgcaagcagcaggagttccgactcttccatggagtggatcacatgtatacgttcttctatttctgtatagttttgctcctctttttttatcggctgctatgttgcttaaaattaaatccaaatcaactgtaggtgaaagttccgcaagaaacctgccacttgatacctgaggacatctataagaaagcttgtgt

SEQ ID NO: 3844 - DNA, 200 bp, Lolium multiflorum
acacaagctttcttatagatgtcctcaggtatcaagtggcaggtttcttgcggaactttcacctacagttgatttggatttaattttaagcaacatagcagccgataaaaaaagaggagcaaaactatacagaaatagaagaacgtatacatgtgatccactccatggaagagtcggaactcctgctgcttgcgcaataa

SEQ ID NO: 3845 - DNA, 200 bp, Lolium multiflorum
aggacatctataagaaagcttgtgttacaactacggaggaagcggtggctagttgtcaggtggtggggtatcctgcaatgatcaaggcatcatggggtggtggtggtaaaggaataaggaaggttggtcttctttttagttcgactctaccgcaattatatggaaagtctctgttcacaaacgatacatggaaatgtcca

SEQ ID NO: 3846 - DNA, 200 bp, Lolium multiflorum
tggacatttccatgtatcgtttgtgaacagagactttccatataattgcggtagagtcgaactaaaaagaagaccaaccttccttattcctttaccaccaccaccccatgatgccttgatcattgcaggataccccaccacctgacaactagccaccgcttcctccgtagttgtaacacaagctttcttatagatgtcct

SEQ ID NO: 3847 - DNA, 200 bp, Lolium multiflorum
cacaaacgatacatggaaatgtccactgtccatacaaaacgaagctaggtttcggcaaatattgtagaataaacgaaagatgattttgatgtcatccaaatgctttttataggtccacaatgatgatgaggtgagagccttgtttaagcaagtgcaaggagaagtccccggatcacctatatttatcatgaaggtggcat

SEQ ID NO: 3848 - DNA, 200 bp, Lolium multiflorum
atgccaccttcatgataaatataggtgatccggggacttctccttgcacttgcttaaacaaggctctcacctcatcatcattgtggacctataaaaagcatttggatgacatcaaaatcatctttcgtttattctacaatatttgccgaaacctagcttcgttttgtatggacagtggacatttccatgtatcgtttgtg

SEQ ID NO: 3849 - DNA, 200 bp, Lolium multiflorum
gacatgaggataaatgcagagcacattagaattgctgatcagtttgttgaagtacctggtggaacaaacaataacaactatgcaaatgtccaactcatagtggagatagcagagagaacaggtgtttcggccgtttggcctggttggggccatgcatctgagaatcctgaacttccagatgcactcactgcaaaaggaat

SEQ ID NO: 3850 - DNA, 200 bp, Lolium multiflorum
attccttttgcagtgagtgcatctggaagttcaggattctcagatgcatggccccaaccaggccaaacggccgaaacacctgttctctctgctatctccactatgagttggacatttgcatagttgttattgtttgttccaccaggtacttcaacaaactgatcagcaattctaatgtgctctgcatttatcctcatgtc

SEQ ID NO: 3851 - DNA, 200 bp, Lolium multiflorum
cagatgcactcactgcaaaaggaattgtttttcttgggccaccagcatcatcaatgaacgcattaggtgacaaggttggttcagctctcattgctcaagcagcaggggttccgactcttgcttggagtggatcacatgtggaaattccattagaactttgcttggactctatacctgaggagatgtataggaaagcttgt

SEQ ID NO: 3852 - DNA, 200 bp, Lolium multiflorum
acaagctttcctatacatctcctcaggtatagagtccaagcaaagttctaatggaatttccacatgtgatccactccaagcaagagtcggaacccctgctgcttgagcaatgagagctgaaccaaccttgtcacctaatgcgttcattgatgatgctggtggcccaagaaaaacaattccttttgcagtgagtgcatctg

SEQ ID NO: 3853 - DNA, 200 bp, Lolium multiflorum
tgaggagatgtataggaaagcttgtgttactaccgcggatgaagcagttgcaagttgtcagatgattggttatcctgccatgatcaaggcatcctggggtggtggtggtaaagggattagaaaggttaataatgatgatgaggttaaagcactgtttaagcaagtacagggtgaagttcctggctccccaatatttatca

SEQ ID NO: 3854 - DNA, 200 bp, Lolium multiflorum
tgataaatattggggagccaggaacttcaccctgtacttgcttaaacagtgctttaacctcatcatcattattaacctttctaatccctttaccaccaccaccccaggatgccttgatcatggcaggataaccaatcatctgacaacttgcaactgcttcatccgcggtagtaacacaagctttcctatacatctcctca

SEQ ID NO: 3855 - DNA, 200 bp, Lolium multiflorum
gttcctggctccccaatatttatcatgagacttgcatctcagagtcgacatcttgaagtccagctgctttgtgatcaatatggcaatgtagcagcacttcacagtcgtgattgcagtgtgcaacgacgacaccaaaagataattgaggaaggaccagttactgttgctccccgtgagacagtgaaggagcttagagcaag

SEQ ID NO: 3856 - DNA, 200 bp, Lolium multiflorum
cttgctctaagctccttcactgtctcacggggagcaacagtaactggtccttcctcaattatcttttggtgtcgtcgttgcacactgcaatcacgactgtgaagtgctgctacattgccatattgatcacaaagcagctggacttcaagatgtcgactctgagatgcaagtctcatgataaatattggggagccaggaac

SEQ ID NO: 3857 - DNA, 200 bp, Lolium multiflorum
gcagagctacgtggaggggcttgggtcgtgattgatagcaagataaatccagatcgcattgagtgctatgctgagacaactgcaaaagggaatgttctcgagcctcaagggttgattgagatcaagttcaggtcagaggaactccaagaatgcatgggtaggcttgatccagaattgataaatctgaaagcacaactcca

SEQ ID NO: 3858 - DNA, 200 bp, Lolium multiflorum
tggagttgtgctttcagatttatcaattctggatcaagcctacccatgcattcttggagttcctctgacctgaacttgatctcaatcaacccttgaggctcgagaacattcccttttgcagttgtctcagcatagcactcaatgcgatctggatttatcttgctatcaatcacgacccaagcccctccacgtagctctgc

SEQ ID NO: 3859 - DNA, 200 bp, Lolium multiflorum
tgataaatctgaaagcacaactccagggagcaaagcatgaaaatggaagtctatctgatggagaatccattcagaagagcatcgaagctcgaaagaacagttgctgcctttgtacactcaaatcgcgatacggtttgctgaattgcatgatacttccctcagaatgcttgctaaaggtgtgattaggaaaattgtagatt

SEQ ID NO: 3860 - DNA, 200 bp, Lolium multiflorum
aatctacaattttcctaatcacacctttagcaagcattctgagggaagtatcatgcaattcagcaaaccgtatcgcgatttgagtgtacaaaggcagcaactgttctttcgagcttcgatgctcttctgaatggattctccatcagatagacttccattttcatgctttgctccctggagttgtgctttcagatttatca

SEQ ID NO: 3861 - DNA, 200 bp, Lolium multiflorum
ggtgtgattaggaaaattgtagattgggaagaatctcggtctttcttctacaagagattacggcggaggatatctgaggatgttcttgcaaaagaaataagaagtgtaattggtgtcgagtcttctcacaaatcagcaatggagttgattaagaagtggtacttggcttctgagacagctggaggaagcactgaatggga

SEQ ID NO: 3862 - DNA, 200 bp, Lolium multiflorum
tcccattcagtgcttcctccagctgtctcagaagccaagtaccacttcttaatcaactccattgctgatttgtgagaagactcgacaccaattacacttcttatttcttttgcaagaacatcctcagatatcctccgccgtaatctcttgtagaagaaagaccgagattcttcccaatctacaattttcctaatcacacc

SEQ ID NO: 3863 - DNA, 200 bp, Lolium multiflorum
cagctggaggaagcactgaatgggatgatgatgatgcttttgttgcctggagggagaaccctgaaaactacaaggagcatatcaaagagcttagggctcaaagggtatctcaggtgctctcagatgttgcagactccagttcggatttacaagccttgccacagggtctttccatgctactagataagatggatccctct

SEQ ID NO: 3864 - DNA, 200 bp, Lolium multiflorum
agagggatccatcttatctagtagcatggaaagaccctgtggcaaggcttgtaaatccgaactggagtctgcaacatctgagagcacctgagataccctttgagccctaagctctttgatatgctccttgtagttttcagggttctccctccaggcaacaaaagcatcatcatcatcccattcagtgcttcctccagctg

SEQ ID NO: 3865 - DNA, 200 bp, Lolium multiflorum
ttctctgtagagccgacatctagaggttcagctgctctgtgacaaacacggcaatgtagcagcactgcacagtcgagactgtagtgttcaaagaaggcaccaaaaggttagaaattctcctgaaaagttatgttgtccaatatcagtttccttggagctaatacatgccgaaacattgtatactgagtactggtagaagt

SEQ ID NO: 3866 - DNA, 200 bp, Lolium multiflorum
acttctaccagtactcagtatacaatgtttcggcatgtattagctccaaggaaactgatattggacaacataacttttcaggagaatttctaaccttttggtgccttctttgaacactacagtctcgactgtgcagtgctgctacattgccgtgtttgtcacagagcagctgaacctctagatgtcggctctacagagaa

SEQ ID NO: 3867 - DNA, 200 bp, Sorghum halepense
ctcacagatgtatctgtgcttactgagagaacaacaattgcatgaactaattccattttcaaggatgactgatgaaattgatcaggatgaaggaactgcatgtacacttttgaagcatatggtattgaatttatatgaacatgttggggtcaggatgcatcgtctttctgtgtgccagtgggaagtcaagctctggttgg

SEQ ID NO: 3868 - DNA, 200 bp, Sorghum halepense
ccaaccagagcttgacttcccactggcacacagaaagacgatgcatcctgaccccaacatgttcatataaattcaataccatatgcttcaaaagtgtacatgcagttccttcatcctgatcaatttcatcagtcatccttgaaaatggaattagttcatgcaattgttgttctctcagtaagcacagatacatctgtgag

SEQ ID NO: 3869 - DNA, 200 bp, Sorghum halepense
cagtgggaagtcaagctctggttggtttgtgatgggcaagctagtggtgcttggagagttgttgttaccaatgttactggtcacacctgcaccattgatatttaccgagaagtggaagaccccagcacacatcagcttctctaccactctgccacagccacggctggtcctttgcatggtgttgcattgaatgaaccata

SEQ ID NO: 3870 - DNA, 200 bp, Sorghum halepense
tatggttcattcaatgcaacaccatgcaaaggaccagccgtggctgtggcagagtggtagagaagctgatgtgtgctggggtcttccacttctcggtaaatatcaatggtgcaggtgtgaccagtaacattggtaacaacaactctccaagcaccactagcttgcccatcacaaaccaaccagagcttgacttcccactg

SEQ ID NO: 3871 - DNA, 200 bp, Sorghum halepense
atggtgttgcattgaatgaaccatacaagcctttggacgctattgacctcaaacgttatgctgctaggaaaaatgaaaccacatactgctacgatttccccttggcatttgaaacagcgctgaagagattatggaaatcaagtagctatggtgttagtgaagctaatgagcgcaatcaactctatgctgaagtgaaagag

SEQ ID NO: 3872 - DNA, 200 bp, Sorghum halepense
ctctttcacttcagcatagagttgattgcgctcattagcttcactaacaccatagctacttgatttccataatctcttcagcgctgtttcaaatgccaaggggaaatcgtagcagtatgtggtttcatttttcctagcagcataacgtttgaggtcaatagcgtccaaaggcttgtatggttcattcaatgcaacaccat

SEQ ID NO: 3873 - DNA, 200 bp, Sorghum halepense
tcaactctatgctgaagtgaaagagcttatatttgttgattcggatggagcatggggcactccattggtttcatttgaacgccctccaggcatcaatgatattggcattgttgcttggaacatgaagctgtccacgccagaattcccaagtggccgggagattatagttgttgccaatgatgtgacatttaaagctgggt

SEQ ID NO: 3874 - DNA, 200 bp, Sorghum halepense
acccagctttaaatgtcacatcattggcaacaactataatctcccggccacttgggaattctggcgtggacagcttcatgttccaagcaacaatgccaatatcattgatgcctggagggcgttcaaatgaaaccaatggagtgccccatgctccatccgaatcaacaaatataagctctttcacttcagcatagagttga

SEQ ID NO: 3875 - DNA, 200 bp, Sorghum halepense
aatgatgtgacatttaaagctgggtcctttggtccaagagaagatgcattttttgatgctgttaccaatcttgcctgtgagaggaaacttcctcttatctatctggcagcaactgctggtgccaggcttggtgtagctgaggaaataaagtcatgcttccatgtcggctggtctgatgatgagagccctgaacgtggttt

SEQ ID NO: 3876 - DNA, 200 bp, Sorghum halepense
aaaccacgttcagggctctcatcatcagaccagccgacatggaagcatgactttatttcctcagctacaccaagcctggcaccagcagttgctgccagatagataagaggaagtttcctctcacaggcaagattggtaacagcatcaaaaaatgcatcttctcttggaccaaaggacccagctttaaatgtcacatcatt

SEQ ID NO: 3877 - DNA, 200 bp, Sorghum halepense
atgatgagagccctgaacgtggttttcagtacatttacctcactacacaagattattcacgtctaagctcttcagtaatagctcacgagctgcaactagaaaatggagaaaccagatgggtggttgataccattgttggtaaagaggatggacttggttgtgagaatctccatggaagtggtgcgattgccagtgcatat

SEQ ID NO: 3878 - DNA, 200 bp, Sorghum halepense
atatgcactggcaatcgcaccacttccatggagattctcacaaccaagtccatcctctttaccaacaatggtatcaaccacccatctggtttctccattttctagttgcagctcgtgagctattactgaagagcttagacgtgaataatcttgtgtagtgaggtaaatgtactgaaaaccacgttcagggctctcatcat

SEQ ID NO: 3879 - DNA, 200 bp, Sorghum halepense
aagtggtgcgattgccagtgcatattccaaggcatacaaagagacctttactctgacatttgtgactggaagagctgttggcattggggcttatctggctcgtttaggtatgaggtgtatacaacgtcttgatcaaccaattattctgactgggttttctgcactaaacaagcttctggggcgggaggtgtacagttctc

SEQ ID NO: 3880 - DNA, 200 bp, Sorghum halepense
gagaactgtacacctcccgccccagaagcttgtttagtgcagaaaacccagtcagaataattggttgatcaagacgttgtatacacctcatacctaaacgagccagataagccccaatgccaacagctcttccagtcacaaatgtcagagtaaaggtctctttgtatgccttggaatatgcactggcaatcgcaccactt

SEQ ID NO: 3881 - DNA, 200 bp, Sorghum halepense
ctggggcgggaggtgtacagttctcatatgcaattgggtggccccaaaatcatggctacaaatggtgttgtccaccaaactgtgtcagatgaccttgaaggtgtttctgctatcctgaaatggctcagttatgttcctccatatgttggtggtcctcttcccattatgaaacccctggacccacccgaaagaccagtagc

SEQ ID NO: 3882 - DNA, 200 bp, Sorghum halepense
gctactggtctttcgggtgggtccaggggtttcataatgggaagaggaccaccaacatatggaggaacataactgagccatttcaggatagcagaaacaccttcaaggtcatctgacacagtttggtggacaacaccatttgtagccatgattttggggccacccaattgcatatgagaactgtacacctcccgccccag

SEQ ID NO: 3883 - DNA, 200 bp, Sorghum halepense
tggacccacccgaaagaccagtagcatacttccctgagaatgcttgtgatgctcgtgcagccatctgtggcattcaagacggtgaagggaagtggttaggtggtatgtttgatagggaaaccttcgtggaaacattggaaggttgggcaaaaacagttatcaccggaagagcaaagcttggtggaataccagttggtgtc

SEQ ID NO: 3884 - DNA, 200 bp, Sorghum halepense
gacaccaactggtattccaccaagctttgctcttccggtgataactgtttttgcccaaccttccaatgtttccacgaaggtttccctatcaaacataccacctaaccacttcccttcaccgtcttgaatgccacagatggctgcacgagcatcacaagcattctcagggaagtatgctactggtctttcgggtgggtcca

SEQ ID NO: 3885 - DNA, 200 bp, Sorghum halepense
gcttggtggaataccagttggtgtcatagctgtggaaacccagactgtgatgcaagtcatcccagctgatccaggtcagcttgattccgctgagcgtgtagtccctcaagcaggtcaggtgtggttcccagattctgcagccaaaacagctcaggcattaatggatttcaaccgtgaggagcttccactgttcatccttg

SEQ ID NO: 3886 - DNA, 200 bp, Sorghum halepense
caaggatgaacagtggaagctcctcacggttgaaatccattaatgcctgagctgttttggctgcagaatctgggaaccacacctgacctgcttgagggactacacgctcagcggaatcaagctgacctggatcagctgggatgacttgcatcacagtctgggtttccacagctatgacaccaactggtattccaccaagc

SEQ ID NO: 3887 - DNA, 200 bp, Xanthium strumarium
gttgttgtcaagtctctatttgaggagtatctgtctgttgaagaactcttcaatgataaccttcagtctgatgttatagagcgtctacgtcttcaacatgcaaaagaccttgagaaggttgtacacattgtgttctcgcaccagggtgtgagaaacaaaaataaattaatactacggcttatggaagcattagtatatcc

SEQ ID NO: 3888 - DNA, 200 bp, Xanthium strumarium
ggatatactaatgcttccataagccgtagtattaatttatttttgtttctcacaccctggtgcgagaacacaatgtgtacaaccttctcaaggtcttttgcatgttgaagacgtagacgctctataacatcagactgaaggttatcattgaagagttcttcaacagacagatactcctcaaatagagacttgacaacaac

SEQ ID NO: 3889 - DNA, 200 bp, Xanthium strumarium
ggcttatggaagcattagtatatccaaacccatctgcttacagagaccagttgattcgcttctctgccttgaaccatacatcttattctgagttggcacttaaagcaagccaacttctagagcatactaaattgagtgaacttcgaacaagcatagcaagaagcctttcagagttggagatgtttactgaggaaggagaa

SEQ ID NO: 3890 - DNA, 200 bp, Xanthium strumarium
ttctccttcctcagtaaacatctccaactctgaaaggcttcttgctatgcttgttcgaagttcactcaatttagtatgctctagaagttggcttgctttaagtgccaactcagaataagatgtatggttcaaggcagagaagcgaatcaactggtctctgtaagcagatgggtttggatatactaatgcttccataagcc

SEQ ID NO: 3891 - DNA, 200 bp, Xanthium strumarium
ggagatgtttactgaggaaggagaacgggtgtcaacacctaggagaaagatggcaataaatgagaggatggaagatttagtatgtgctccactggcagttgaagatgctcttgtagctttgtttgatcacagcgatcctacacttcagcggagggttgttgagacatatatacgtcgattgtatcagccctaccttgtaa

SEQ ID NO: 3892 - DNA, 200 bp, Xanthium strumarium
ttacaaggtagggctgatacaatcgacgtatatatgtctcaacaaccctccgctgaagtgtaggatcgctgtgatcaaacaaagctacaagagcatcttcaactgccagtggagcacatactaaatcttccatcctctcatttattgccatctttctcctaggtgttgacacccgttctccttcctcagtaaacatctcc

SEQ ID NO: 3893 - DNA, 200 bp, Xanthium strumarium
cgattgtatcagccctaccttgtaagtggaagtatccggatgcaatggcaccgagctggcttaattgctttatgggagttctctgaagagcatcttaagcaaagaaatgggcacgatgtgcttgtacagcaagtagagaatcccattgagaagagatggggtgtcatggttgtaatcaagtctcttcagtttctagcaac

SEQ ID NO: 3894 - DNA, 200 bp, Xanthium strumarium
gttgctagaaactgaagagacttgattacaaccatgacaccccatctcttctcaatgggattctctacttgctgtacaagcacatcgtgcccatttctttgcttaagatgctcttcagagaactcccataaagcaattaagccagctcggtgccattgcatccggatacttccacttacaaggtagggctgatacaatcg

SEQ ID NO: 3895 - DNA, 200 bp, Xanthium strumarium
tcaagtctcttcagtttctagcaactgcaattgatgctgcactgaaggagacctcgcaatatagagcaggtgctgtaagtgtctcgaatggtaaccatgtaaattcaaatcaaagcaatatgctgcatattgctttggttggtatcaataatcagatgagtactctccaagacagtggtgacgaggatcaagcacaggaa

SEQ ID NO: 3896 - DNA, 200 bp, Xanthium strumarium
ttcctgtgcttgatcctcgtcaccactgtcttggagagtactcatctgattattgataccaaccaaagcaatatgcagcatattgctttgatttgaatttacatggttaccattcgagacacttacagcacctgctctatattgcgaggtctccttcagtgcagcatcaattgcagttgctagaaactgaagagacttga

SEQ ID NO: 3897 - DNA, 200 bp, Xanthium strumarium
tggtgacgaggatcaagcacaggaaaggatcaacaaactatccaaaattttgaaggataatactattacatcgcaacttaatggtgctggtgttaaggtcgtcagttgcattatccaaagagatgaagggcgtccaccaatgcgacactccttccattggtctgttgacaagctttattatgaggaggatccaatgctcc

SEQ ID NO: 3898 - DNA, 200 bp, Xanthium strumarium
ggagcattggatcctcctcataataaagcttgtcaacagaccaatggaaggagtgtcgcattggtggacgcccttcatctctttggataatgcaactgacgaccttaacaccagcaccattaagttgcgatgtaatagtattatccttcaaaattttggatagtttgttgatcctttcctgtgcttgatcctcgtcacca

SEQ ID NO: 3899 - DNA, 200 bp, Xanthium strumarium
tattatgaggaggatccaatgctccgccacgtggaaccaccattgtctacattccttgagctggacaaagtaaatttggagggttacactgaagtaaaatacaccccatcacgtgatcgtcagtggcatatttacacacttatcaagaacaagaaagatcagagattaaacgaccagaggatgttccttcgtaccatagt

SEQ ID NO: 3900 - DNA, 200 bp, Xanthium strumarium
actatggtacgaaggaacatcctctggtcgtttaatctctgatctttcttgttcttgataagtgtgtaaatatgccactgacgatcacgtgatggggtgtattttacttcagtgtaaccctccaaatttactttgtccagctcaaggaatgtagacaatggtggttccacgtggcggagcattggatcctcctcataata

SEQ ID NO: 3901 - DNA, 21 bp, Unknown
  Found in multiple species
tattggtgcctatcttgctcg

SEQ ID NO: 3902 - DNA, 21 bp, Unknown
  Found in multiple species
gtattggtgcctatcttgctc

SEQ ID NO: 3903 - DNA, 21 bp, Unknown
  Found in multiple species
ggtattggtgcctatcttgct

SEQ ID NO: 3904 - DNA, 21 bp, Unknown
  Found in multiple species
gagcaagataggcaccaatac

SEQ ID NO: 3905 - DNA, 21 bp, Unknown
  Found in multiple species
cgagcaagataggcaccaata

SEQ ID NO: 3906 - DNA, 21 bp, Unknown
  Found in multiple species
agcaagataggcaccaatacc

SEQ ID NO: 3907 - DNA, 21 bp, Unknown
  Found in multiple species
tttttccttgagaccgatgag

SEQ ID NO: 3908 - DNA, 21 bp, Unknown
  Found in multiple species
ttttgtggaaaccttagaagg

SEQ ID NO: 3909 - DNA, 21 bp, Unknown
  Found in multiple species
ttttccttgagaccgatgagt

SEQ ID NO: 3910 - DNA, 21 bp, Unknown
  Found in multiple species
tttctcggtgtttagaccctc

SEQ ID NO: 3911 - DNA, 21 bp, Unknown
  Found in multiple species
tttccttgagaccgatgagtt

SEQ ID NO: 3912 - DNA, 21 bp, Unknown
  Found in multiple species
tttccgatgatcttgaaggca

SEQ ID NO: 3913 - DNA, 21 bp, Unknown
  Found in multiple species
tttcatgtaggttgctatctt

SEQ ID NO: 3914 - DNA, 21 bp, Unknown
  Found in multiple species
tttcatctatcttgaagtggc

SEQ ID NO: 3915 - DNA, 21 bp, Unknown
  Found in multiple species
tttatcgtgaattggaagata

SEQ ID NO: 3916 - DNA, 21 bp, Unknown
  Found in multiple species
tttagcccttcccgtgacaac

SEQ ID NO: 3917 - DNA, 21 bp, Unknown
  Found in multiple species
ttgtcacgggaagggctaaac

SEQ ID NO: 3918 - DNA, 21 bp, Unknown
  Found in multiple species
ttgtatacagaggcttgacca

SEQ ID NO: 3919 - DNA, 21 bp, Unknown
  Found in multiple species
ttgggatgcgttgtatacaga

SEQ ID NO: 3920 - DNA, 21 bp, Unknown
  Found in multiple species
ttggatgcggaatctgggaac

SEQ ID NO: 3921 - DNA, 21 bp, Unknown
  Found in multiple species
ttggaagatagcaacctacat

SEQ ID NO: 3922 - DNA, 21 bp, Unknown
  Found in multiple species
ttgctatcttccaattcacga

SEQ ID NO: 3923 - DNA, 21 bp, Unknown
  Found in multiple species
ttgcgtatttgcctgaaaatt

SEQ ID NO: 3924 - DNA, 21 bp, Unknown
  Found in multiple species
ttgccctgcttgtggtacgac

SEQ ID NO: 3925 - DNA, 21 bp, Unknown
  Found in multiple species
ttgaccgggatctgctgggat

SEQ ID NO: 3926 - DNA, 21 bp, Unknown
  Found in multiple species
ttgaccagcctataattctca

SEQ ID NO: 3927 - DNA, 21 bp, Unknown
  Found in multiple species
ttgaaggcatttcatctatct

SEQ ID NO: 3928 - DNA, 21 bp, Unknown
  Found in multiple species
ttctcggtgtttagaccctcc

SEQ ID NO: 3929 - DNA, 21 bp, Unknown
  Found in multiple species
ttctcgagtgtatgggaaggc

SEQ ID NO: 3930 - DNA, 21 bp, Unknown
  Found in multiple species
ttctaaggtttccacaaaact

SEQ ID NO: 3931 - DNA, 21 bp, Unknown
  Found in multiple species
ttcggtccaccaagttgcatg

SEQ ID NO: 3932 - DNA, 21 bp, Unknown
  Found in multiple species
ttcggtacatgtttatcgtga

SEQ ID NO: 3933 - DNA, 21 bp, Unknown
  Found in multiple species
ttccttgagaccgatgagttg

SEQ ID NO: 3934 - DNA, 21 bp, Unknown
  Found in multiple species
ttccgatttctcggtgtttag

SEQ ID NO: 3935 - DNA, 21 bp, Unknown
  Found in multiple species
ttccgatgatcttgaaggcat

SEQ ID NO: 3936 - DNA, 21 bp, Unknown
  Found in multiple species
ttcccatacactcgagaagtt

SEQ ID NO: 3937 - DNA, 21 bp, Unknown
  Found in multiple species
ttcccagattccgcatccaag

SEQ ID NO: 3938 - DNA, 21 bp, Unknown
  Found in multiple species
ttccaattcacgataaacatg

SEQ ID NO: 3939 - DNA, 21 bp, Unknown
  Found in multiple species
ttcatgtaggttgctatcttc

SEQ ID NO: 3940 - DNA, 21 bp, Unknown
  Found in multiple species
ttcatcttacagtttccgatg

SEQ ID NO: 3941 - DNA, 21 bp, Unknown
  Found in multiple species
ttcatctatcttgaagtggct

SEQ ID NO: 3942 - DNA, 21 bp, Unknown
  Found in multiple species
ttcacgataaacatgtaccga

SEQ ID NO: 3943 - DNA, 21 bp, Unknown
  Found in multiple species
ttcacaggtaccccatggtgg

SEQ ID NO: 3944 - DNA, 21 bp, Unknown
  Found in multiple species
ttcacacatgcaacttggtgg

SEQ ID NO: 3945 - DNA, 21 bp, Unknown
  Found in multiple species
ttcaagatcatcggaaactgt

SEQ ID NO: 3946 - DNA, 21 bp, Unknown
  Found in multiple species
ttcaagatagatgaaatgcct

SEQ ID NO: 3947 - DNA, 21 bp, Unknown
  Found in multiple species
ttatgcaagtaatcccagcag

SEQ ID NO: 3948 - DNA, 21 bp, Unknown
  Found in multiple species
ttatcgtgaattggaagatag

SEQ ID NO: 3949 - DNA, 21 bp, Unknown
  Found in multiple species
ttataggctggtcaagcctct

SEQ ID NO: 3950 - DNA, 21 bp, Unknown
  Found in multiple species
ttagcccttcccgtgacaact

SEQ ID NO: 3951 - DNA, 21 bp, Unknown
  Found in multiple species
ttacagtttccgatgatcttg

SEQ ID NO: 3952 - DNA, 21 bp, Unknown
  Found in multiple species
tgtttatcgtgaattggaaga

SEQ ID NO: 3953 - DNA, 21 bp, Unknown
  Found in multiple species
tgttcggtacatgtttatcgt

SEQ ID NO: 3954 - DNA, 21 bp, Unknown
  Found in multiple species
tgttatgcaagtaatcccagc

SEQ ID NO: 3955 - DNA, 21 bp, Unknown
  Found in multiple species
tgtgagtcgagttgaccggga

SEQ ID NO: 3956 - DNA, 21 bp, Unknown
  Found in multiple species
tgtcttggatgcggaatctgg

SEQ ID NO: 3957 - DNA, 21 bp, Unknown
  Found in multiple species
tgtcacgggaagggctaaact

SEQ ID NO: 3958 - DNA, 21 bp, Unknown
  Found in multiple species
tgtatacagaggcttgaccag

SEQ ID NO: 3959 - DNA, 21 bp, Unknown
  Found in multiple species
tgtaggttgctatcttccaat

SEQ ID NO: 3960 - DNA, 21 bp, Unknown
  Found in multiple species
tgtaagatgaactaccccgtt

SEQ ID NO: 3961 - DNA, 21 bp, Unknown
  Found in multiple species
tggttcccagattccgcatcc

SEQ ID NO: 3962 - DNA, 21 bp, Unknown
  Found in multiple species
tggtgaacttccgatttctcg

SEQ ID NO: 3963 - DNA, 21 bp, Unknown
  Found in multiple species
tggtcaagcctctgtatacaa

SEQ ID NO: 3964 - DNA, 21 bp, Unknown
  Found in multiple species
tggtagaccatttcatgtagg

SEQ ID NO: 3965 - DNA, 21 bp, Unknown
  Found in multiple species
tggggtacctgtgaatgcacc

SEQ ID NO: 3966 - DNA, 21 bp, Unknown
  Found in multiple species
tgggcacaaacggggtagttc

SEQ ID NO: 3967 - DNA, 21 bp, Unknown
  Found in multiple species
tgggattacttgcataacagt

SEQ ID NO: 3968 - DNA, 21 bp, Unknown
  Found in multiple species
tgggatgcgttgtatacagag

SEQ ID NO: 3969 - DNA, 21 bp, Unknown
  Found in multiple species
tgggaaccatacttgccctgc

SEQ ID NO: 3970 - DNA, 21 bp, Unknown
  Found in multiple species
tggatgcggaatctgggaacc

SEQ ID NO: 3971 - DNA, 21 bp, Unknown
  Found in multiple species
tggaagatagcaacctacatg

SEQ ID NO: 3972 - DNA, 21 bp, Unknown
  Found in multiple species
tgcttgtggtacgactctctc

SEQ ID NO: 3973 - DNA, 21 bp, Unknown
  Found in multiple species
tgctgggattacttgcataac

SEQ ID NO: 3974 - DNA, 21 bp, Unknown
  Found in multiple species
tgctatcttccaattcacgat

SEQ ID NO: 3975 - DNA, 21 bp, Unknown
  Found in multiple species
tgcgttgtatacagaggcttg

SEQ ID NO: 3976 - DNA, 21 bp, Unknown
  Found in multiple species
tgcggaatctgggaaccatac

SEQ ID NO: 3977 - DNA, 21 bp, Unknown
  Found in multiple species
tgccttcaagatcatcggaaa

SEQ ID NO: 3978 - DNA, 21 bp, Unknown
  Found in multiple species
tgccctgcttgtggtacgact

SEQ ID NO: 3979 - DNA, 21 bp, Unknown
  Found in multiple species
tgcattcacaggtaccccatg

SEQ ID NO: 3980 - DNA, 21 bp, Unknown
  Found in multiple species
tgcaagtaatcccagcagatc

SEQ ID NO: 3981 - DNA, 21 bp, Unknown
  Found in multiple species
tgcaacttggtggaccgaaga

SEQ ID NO: 3982 - DNA, 21 bp, Unknown
  Found in multiple species
tgatcttgaaggcatttcatc

SEQ ID NO: 3983 - DNA, 21 bp, Unknown
  Found in multiple species
tgagtcgagttgaccgggatc

SEQ ID NO: 3984 - DNA, 21 bp, Unknown
  Found in multiple species
tgagaattataggctggtcaa

SEQ ID NO: 3985 - DNA, 21 bp, Unknown
  Found in multiple species
tgaccgggatctgctgggatt

SEQ ID NO: 3986 - DNA, 21 bp, Unknown
  Found in multiple species
tgaccagcctataattctcac

SEQ ID NO: 3987 - DNA, 21 bp, Unknown
  Found in multiple species
tgaattggaagatagcaacct

SEQ ID NO: 3988 - DNA, 21 bp, Unknown
  Found in multiple species
tgaatggtagaccatttcatg

SEQ ID NO: 3989 - DNA, 21 bp, Unknown
  Found in multiple species
tgaaggcatttcatctatctt

SEQ ID NO: 3990 - DNA, 21 bp, Unknown
  Found in multiple species
tgaacttccgatttctcggtg

SEQ ID NO: 3991 - DNA, 21 bp, Unknown
  Found in multiple species
tgaactaccccgtttgtgccc

SEQ ID NO: 3992 - DNA, 21 bp, Unknown
  Found in multiple species
tgaaatgccttcaagatcatc

SEQ ID NO: 3993 - DNA, 21 bp, Unknown
  Found in multiple species
tcttggatgcggaatctggga

SEQ ID NO: 3994 - DNA, 21 bp, Unknown
  Found in multiple species
tcttgaaggcatttcatctat

SEQ ID NO: 3995 - DNA, 21 bp, Unknown
  Found in multiple species
tcttcggtccaccaagttgca

SEQ ID NO: 3996 - DNA, 21 bp, Unknown
  Found in multiple species
tcttccaattcacgataaaca

SEQ ID NO: 3997 - DNA, 21 bp, Unknown
  Found in multiple species
tcttacagtttccgatgatct

SEQ ID NO: 3998 - DNA, 21 bp, Unknown
  Found in multiple species
tctgtatacaacgcatcccaa

SEQ ID NO: 3999 - DNA, 21 bp, Unknown
  Found in multiple species
tctgggaaccatacttgccct

SEQ ID NO: 4000 - DNA, 21 bp, Unknown
  Found in multiple species
tctgctgggattacttgcata

SEQ ID NO: 4001 - DNA, 21 bp, Unknown
  Found in multiple species
tctcgagtgtatgggaaggct

SEQ ID NO: 4002 - DNA, 21 bp, Unknown
  Found in multiple species
tctatcttgaagtggctgagc

SEQ ID NO: 4003 - DNA, 21 bp, Unknown
  Found in multiple species
tctaaggtttccacaaaacta

SEQ ID NO: 4004 - DNA, 21 bp, Unknown
  Found in multiple species
tctaaacaccgagaaatcgga

SEQ ID NO: 4005 - DNA, 21 bp, Unknown
  Found in multiple species
tcgtgaattggaagatagcaa

SEQ ID NO: 4006 - DNA, 21 bp, Unknown
  Found in multiple species
tcgtaccacaagcagggcaag

SEQ ID NO: 4007 - DNA, 21 bp, Unknown
  Found in multiple species
tcggtctcaaggaaaaactag

SEQ ID NO: 4008 - DNA, 21 bp, Unknown
  Found in multiple species
tcggtccaccaagttgcatgt

SEQ ID NO: 4009 - DNA, 21 bp, Unknown
  Found in multiple species
tcggtattggtgcctatcttg

SEQ ID NO: 4010 - DNA, 21 bp, Unknown
  Found in multiple species
tcggtacatgtttatcgtgaa

SEQ ID NO: 4011 - DNA, 21 bp, Unknown
  Found in multiple species
tcggaaactgtaagatgaact

SEQ ID NO: 4012 - DNA, 21 bp, Unknown
  Found in multiple species
tcgagttgaccgggatctgct

SEQ ID NO: 4013 - DNA, 21 bp, Unknown
  Found in multiple species
tcgagtgtatgggaaggcttg

SEQ ID NO: 4014 - DNA, 21 bp, Unknown
  Found in multiple species
tccttgagaccgatgagttgt

SEQ ID NO: 4015 - DNA, 21 bp, Unknown
  Found in multiple species
tccgatttctcggtgtttaga

SEQ ID NO: 4016 - DNA, 21 bp, Unknown
  Found in multiple species
tccgatgatcttgaaggcatt

SEQ ID NO: 4017 - DNA, 21 bp, Unknown
  Found in multiple species
tcccggtcaactcgactcaca

SEQ ID NO: 4018 - DNA, 21 bp, Unknown
  Found in multiple species
tcccatacactcgagaagttc

SEQ ID NO: 4019 - DNA, 21 bp, Unknown
  Found in multiple species
tcccagcagatcccggtcaac

SEQ ID NO: 4020 - DNA, 21 bp, Unknown
  Found in multiple species
tcccagattccgcatccaaga

SEQ ID NO: 4021 - DNA, 21 bp, Unknown
  Found in multiple species
tccaccaagttgcatgtgtga

SEQ ID NO: 4022 - DNA, 21 bp, Unknown
  Found in multiple species
tccaattcacgataaacatgt

SEQ ID NO: 4023 - DNA, 21 bp, Unknown
  Found in multiple species
tcatgtaggttgctatcttcc

SEQ ID NO: 4024 - DNA, 21 bp, Unknown
  Found in multiple species
tcatcttacagtttccgatga

SEQ ID NO: 4025 - DNA, 21 bp, Unknown
  Found in multiple species
tcatctatcttgaagtggctg

SEQ ID NO: 4026 - DNA, 21 bp, Unknown
  Found in multiple species
tcatcggtctcaaggaaaaac

SEQ ID NO: 4027 - DNA, 21 bp, Unknown
  Found in multiple species
tcatcggaaactgtaagatga

SEQ ID NO: 4028 - DNA, 21 bp, Unknown
  Found in multiple species
tcagccacttcaagatagatg

SEQ ID NO: 4029 - DNA, 21 bp, Unknown
  Found in multiple species
tcacgataaacatgtaccgaa

SEQ ID NO: 4030 - DNA, 21 bp, Unknown
  Found in multiple species
tcacaggtaccccatggtggg

SEQ ID NO: 4031 - DNA, 21 bp, Unknown
  Found in multiple species
tcacacatgcaacttggtgga

SEQ ID NO: 4032 - DNA, 21 bp, Unknown
  Found in multiple species
tcaagccttcccatacactcg

SEQ ID NO: 4033 - DNA, 21 bp, Unknown
  Found in multiple species
tcaagcctctgtatacaacgc

SEQ ID NO: 4034 - DNA, 21 bp, Unknown
  Found in multiple species
tcaagatcatcggaaactgta

SEQ ID NO: 4035 - DNA, 21 bp, Unknown
  Found in multiple species
tcaagatagatgaaatgcctt

SEQ ID NO: 4036 - DNA, 21 bp, Unknown
  Found in multiple species
tatggttcccagattccgcat

SEQ ID NO: 4037 - DNA, 21 bp, Unknown
  Found in multiple species
tatgcaagtaatcccagcaga

SEQ ID NO: 4038 - DNA, 21 bp, Unknown
  Found in multiple species
tatcttgaagtggctgagcta

SEQ ID NO: 4039 - DNA, 21 bp, Unknown
  Found in multiple species
tatcttccaattcacgataaa

SEQ ID NO: 4040 - DNA, 21 bp, Unknown
  Found in multiple species
tatcgtgaattggaagatagc

SEQ ID NO: 4041 - DNA, 21 bp, Unknown
  Found in multiple species
tataggctggtcaagcctctg

SEQ ID NO: 4042 - DNA, 21 bp, Unknown
  Found in multiple species
tatacagaggcttgaccagcc

SEQ ID NO: 4043 - DNA, 21 bp, Unknown
  Found in multiple species
tagtttttccttgagaccgat

SEQ ID NO: 4044 - DNA, 21 bp, Unknown
  Found in multiple species
tagttttgtggaaaccttaga

SEQ ID NO: 4045 - DNA, 21 bp, Unknown
  Found in multiple species
tagttcatcttacagtttccg

SEQ ID NO: 4046 - DNA, 21 bp, Unknown
  Found in multiple species
taggttgctatcttccaattc

SEQ ID NO: 4047 - DNA, 21 bp, Unknown
  Found in multiple species
tagggtgcattcacaggtacc

SEQ ID NO: 4048 - DNA, 21 bp, Unknown
  Found in multiple species
taggctggtcaagcctctgta

SEQ ID NO: 4049 - DNA, 21 bp, Unknown
  Found in multiple species
taggcaccaataccgaccgtt

SEQ ID NO: 4050 - DNA, 21 bp, Unknown
  Found in multiple species
taggaattagagctcttggct

SEQ ID NO: 4051 - DNA, 21 bp, Unknown
  Found in multiple species
tagctcagccacttcaagata

SEQ ID NO: 4052 - DNA, 21 bp, Unknown
  Found in multiple species
tagcccttcccgtgacaactg

SEQ ID NO: 4053 - DNA, 21 bp, Unknown
  Found in multiple species
tagcaacctacatgaaatggt

SEQ ID NO: 4054 - DNA, 21 bp, Unknown
  Found in multiple species
tagatgaaatgccttcaagat

SEQ ID NO: 4055 - DNA, 21 bp, Unknown
  Found in multiple species
tagaccatttcatgtaggttg

SEQ ID NO: 4056 - DNA, 21 bp, Unknown
  Found in multiple species
tacttgccctgcttgtggtac

SEQ ID NO: 4057 - DNA, 21 bp, Unknown
  Found in multiple species
taccacaagcagggcaagtat

SEQ ID NO: 4058 - DNA, 21 bp, Unknown
  Found in multiple species
tacatgtttatcgtgaattgg

SEQ ID NO: 4059 - DNA, 21 bp, Unknown
  Found in multiple species
tacatgaaatggtctaccatt

SEQ ID NO: 4060 - DNA, 21 bp, Unknown
  Found in multiple species
tacagtttccgatgatcttga

SEQ ID NO: 4061 - DNA, 21 bp, Unknown
  Found in multiple species
tacagaggcttgaccagccta

SEQ ID NO: 4062 - DNA, 21 bp, Unknown
  Found in multiple species
tacactcgagaagttccttgg

SEQ ID NO: 4063 - DNA, 21 bp, Unknown
  Found in multiple species
taatcccagcagatcccggtc

SEQ ID NO: 4064 - DNA, 21 bp, Unknown
  Found in multiple species
taaggtttccacaaaactatc

SEQ ID NO: 4065 - DNA, 21 bp, Unknown
  Found in multiple species
taagatgaactaccccgtttg

SEQ ID NO: 4066 - DNA, 21 bp, Unknown
  Found in multiple species
taaacaccgagaaatcggaag

SEQ ID NO: 4067 - DNA, 21 bp, Unknown
  Found in multiple species
gtttttccttgagaccgatga

SEQ ID NO: 4068 - DNA, 21 bp, Unknown
  Found in multiple species
gttttgtggaaaccttagaag

SEQ ID NO: 4069 - DNA, 21 bp, Unknown
  Found in multiple species
gtttccgatgatcttgaaggc

SEQ ID NO: 4070 - DNA, 21 bp, Unknown
  Found in multiple species
gtttatcgtgaattggaagat

SEQ ID NO: 4071 - DNA, 21 bp, Unknown
  Found in multiple species
gtttagcccttcccgtgacaa

SEQ ID NO: 4072 - DNA, 21 bp, Unknown
  Found in multiple species
gttgtcacgggaagggctaaa

SEQ ID NO: 4073 - DNA, 21 bp, Unknown
  Found in multiple species
gttgtatacagaggcttgacc

SEQ ID NO: 4074 - DNA, 21 bp, Unknown
  Found in multiple species
gttgctatcttccaattcacg

SEQ ID NO: 4075 - DNA, 21 bp, Unknown
  Found in multiple species
gttgcgtatttgcctgaaaat

SEQ ID NO: 4076 - DNA, 21 bp, Unknown
  Found in multiple species
gttgaccgggatctgctggga

SEQ ID NO: 4077 - DNA, 21 bp, Unknown
  Found in multiple species
gttcggtacatgtttatcgtg

SEQ ID NO: 4078 - DNA, 21 bp, Unknown
  Found in multiple species
gttcccagattccgcatccaa

SEQ ID NO: 4079 - DNA, 21 bp, Unknown
  Found in multiple species
gttcatcttacagtttccgat

SEQ ID NO: 4080 - DNA, 21 bp, Unknown
  Found in multiple species
gttcacacatgcaacttggtg

SEQ ID NO: 4081 - DNA, 21 bp, Unknown
  Found in multiple species
gttatgcaagtaatcccagca

SEQ ID NO: 4082 - DNA, 21 bp, Unknown
  Found in multiple species
gtggtgaacttccgatttctc

SEQ ID NO: 4083 - DNA, 21 bp, Unknown
  Found in multiple species
gtgcattcacaggtaccccat

SEQ ID NO: 4084 - DNA, 21 bp, Unknown
  Found in multiple species
gtgagtcgagttgaccgggat

SEQ ID NO: 4085 - DNA, 21 bp, Unknown
  Found in multiple species
gtgagaattataggctggtca

SEQ ID NO: 4086 - DNA, 21 bp, Unknown
  Found in multiple species
gtgaattggaagatagcaacc

SEQ ID NO: 4087 - DNA, 21 bp, Unknown
  Found in multiple species
gtgaacttccgatttctcggt

SEQ ID NO: 4088 - DNA, 21 bp, Unknown
  Found in multiple species
gtcttggatgcggaatctggg

SEQ ID NO: 4089 - DNA, 21 bp, Unknown
  Found in multiple species
gtctaaacaccgagaaatcgg

SEQ ID NO: 4090 - DNA, 21 bp, Unknown
  Found in multiple species
gtcgtaccacaagcagggcaa

SEQ ID NO: 4091 - DNA, 21 bp, Unknown
  Found in multiple species
gtcggtattggtgcctatctt

SEQ ID NO: 4092 - DNA, 21 bp, Unknown
  Found in multiple species
gtcgagttgaccgggatctgc

SEQ ID NO: 4093 - DNA, 21 bp, Unknown
  Found in multiple species
gtccaccaagttgcatgtgtg

SEQ ID NO: 4094 - DNA, 21 bp, Unknown
  Found in multiple species
gtcaagcctctgtatacaacg

SEQ ID NO: 4095 - DNA, 21 bp, Unknown
  Found in multiple species
gtatggttcccagattccgca

SEQ ID NO: 4096 - DNA, 21 bp, Unknown
  Found in multiple species
gtatacagaggcttgaccagc

SEQ ID NO: 4097 - DNA, 21 bp, Unknown
  Found in multiple species
gtagttcatcttacagtttcc

SEQ ID NO: 4098 - DNA, 21 bp, Unknown
  Found in multiple species
gtaggttgctatcttccaatt

SEQ ID NO: 4099 - DNA, 21 bp, Unknown
  Found in multiple species
gtagaccatttcatgtaggtt

SEQ ID NO: 4100 - DNA, 21 bp, Unknown
  Found in multiple species
gtaccacaagcagggcaagta

SEQ ID NO: 4101 - DNA, 21 bp, Unknown
  Found in multiple species
gtacatgtttatcgtgaattg

SEQ ID NO: 4102 - DNA, 21 bp, Unknown
  Found in multiple species
gtaatcccagcagatcccggt

SEQ ID NO: 4103 - DNA, 21 bp, Unknown
  Found in multiple species
gtaagatgaactaccccgttt

SEQ ID NO: 4104 - DNA, 21 bp, Unknown
  Found in multiple species
ggttgctatcttccaattcac

SEQ ID NO: 4105 - DNA, 21 bp, Unknown
  Found in multiple species
ggttcccagattccgcatcca

SEQ ID NO: 4106 - DNA, 21 bp, Unknown
  Found in multiple species
ggtggtgaacttccgatttct

SEQ ID NO: 4107 - DNA, 21 bp, Unknown
  Found in multiple species
ggtgcattcacaggtacccca

SEQ ID NO: 4108 - DNA, 21 bp, Unknown
  Found in multiple species
ggtgaacttccgatttctcgg

SEQ ID NO: 4109 - DNA, 21 bp, Unknown
  Found in multiple species
ggtctaaacaccgagaaatcg

SEQ ID NO: 4110 - DNA, 21 bp, Unknown
  Found in multiple species
ggtcggtattggtgcctatct

SEQ ID NO: 4111 - DNA, 21 bp, Unknown
  Found in multiple species
ggtccaccaagttgcatgtgt

SEQ ID NO: 4112 - DNA, 21 bp, Unknown
  Found in multiple species
ggtcaagcctctgtatacaac

SEQ ID NO: 4113 - DNA, 21 bp, Unknown
  Found in multiple species
ggtagttcatcttacagtttc

SEQ ID NO: 4114 - DNA, 21 bp, Unknown
  Found in multiple species
ggtagaccatttcatgtaggt

SEQ ID NO: 4115 - DNA, 21 bp, Unknown
  Found in multiple species
ggtacctgtgaatgcacccta

SEQ ID NO: 4116 - DNA, 21 bp, Unknown
  Found in multiple species
ggtacatgtttatcgtgaatt

SEQ ID NO: 4117 - DNA, 21 bp, Unknown
  Found in multiple species
gggtgcattcacaggtacccc

SEQ ID NO: 4118 - DNA, 21 bp, Unknown
  Found in multiple species
gggtctaaacaccgagaaatc

SEQ ID NO: 4119 - DNA, 21 bp, Unknown
  Found in multiple species
gggtagttcatcttacagttt

SEQ ID NO: 4120 - DNA, 21 bp, Unknown
  Found in multiple species
gggtacctgtgaatgcaccct

SEQ ID NO: 4121 - DNA, 21 bp, Unknown
  Found in multiple species
ggggtagttcatcttacagtt

SEQ ID NO: 4122 - DNA, 21 bp, Unknown
  Found in multiple species
ggggtacctgtgaatgcaccc

SEQ ID NO: 4123 - DNA, 21 bp, Unknown
  Found in multiple species
gggcacaaacggggtagttca

SEQ ID NO: 4124 - DNA, 21 bp, Unknown
  Found in multiple species
gggcaagtatggttcccagat

SEQ ID NO: 4125 - DNA, 21 bp, Unknown
  Found in multiple species
gggattacttgcataacagtc

SEQ ID NO: 4126 - DNA, 21 bp, Unknown
  Found in multiple species
gggatgcgttgtatacagagg

SEQ ID NO: 4127 - DNA, 21 bp, Unknown
  Found in multiple species
gggatctgctgggattacttg

SEQ ID NO: 4128 - DNA, 21 bp, Unknown
  Found in multiple species
gggaaccatacttgccctgct

SEQ ID NO: 4129 - DNA, 21 bp, Unknown
  Found in multiple species
ggcttgaccagcctataattc

SEQ ID NO: 4130 - DNA, 21 bp, Unknown
  Found in multiple species
ggctggtcaagcctctgtata

SEQ ID NO: 4131 - DNA, 21 bp, Unknown
  Found in multiple species
ggcatttcatctatcttgaag

SEQ ID NO: 4132 - DNA, 21 bp, Unknown
  Found in multiple species
ggcaccaataccgaccgttct

SEQ ID NO: 4133 - DNA, 21 bp, Unknown
  Found in multiple species
ggcacaaacggggtagttcat

SEQ ID NO: 4134 - DNA, 21 bp, Unknown
  Found in multiple species
ggcaagtatggttcccagatt

SEQ ID NO: 4135 - DNA, 21 bp, Unknown
  Found in multiple species
ggattacttgcataacagtct

SEQ ID NO: 4136 - DNA, 21 bp, Unknown
  Found in multiple species
ggatgcgttgtatacagaggc

SEQ ID NO: 4137 - DNA, 21 bp, Unknown
  Found in multiple species
ggatgcggaatctgggaacca

SEQ ID NO: 4138 - DNA, 21 bp, Unknown
  Found in multiple species
ggatctgctgggattacttgc

SEQ ID NO: 4139 - DNA, 21 bp, Unknown
  Found in multiple species
ggagggtctaaacaccgagaa

SEQ ID NO: 4140 - DNA, 21 bp, Unknown
  Found in multiple species
ggaatgatcgagattaagttc

SEQ ID NO: 4141 - DNA, 21 bp, Unknown
  Found in multiple species
ggaatctgggaaccatacttg

SEQ ID NO: 4142 - DNA, 21 bp, Unknown
  Found in multiple species
ggaagatagcaacctacatga

SEQ ID NO: 4143 - DNA, 21 bp, Unknown
  Found in multiple species
ggaacttctcgagtgtatggg

SEQ ID NO: 4144 - DNA, 21 bp, Unknown
  Found in multiple species
ggaaccatacttgccctgctt

SEQ ID NO: 4145 - DNA, 21 bp, Unknown
  Found in multiple species
ggaaactgtaagatgaactac

SEQ ID NO: 4146 - DNA, 21 bp, Unknown
  Found in multiple species
gcttgaccagcctataattct

SEQ ID NO: 4147 - DNA, 21 bp, Unknown
  Found in multiple species
gctggtcaagcctctgtatac

SEQ ID NO: 4148 - DNA, 21 bp, Unknown
  Found in multiple species
gctgggattacttgcataaca

SEQ ID NO: 4149 - DNA, 21 bp, Unknown
  Found in multiple species
gctcagccacttcaagataga

SEQ ID NO: 4150 - DNA, 21 bp, Unknown
  Found in multiple species
gctatcttccaattcacgata

SEQ ID NO: 4151 - DNA, 21 bp, Unknown
  Found in multiple species
gctagtttttccttgagaccg

SEQ ID NO: 4152 - DNA, 21 bp, Unknown
  Found in multiple species
gcgttgtatacagaggcttga

SEQ ID NO: 4153 - DNA, 21 bp, Unknown
  Found in multiple species
gcggaatctgggaaccatact

SEQ ID NO: 4154 - DNA, 21 bp, Unknown
  Found in multiple species
gccttcccatacactcgagaa

SEQ ID NO: 4155 - DNA, 21 bp, Unknown
  Found in multiple species
gccttcaagatcatcggaaac

SEQ ID NO: 4156 - DNA, 21 bp, Unknown
  Found in multiple species
gcctctgtatacaacgcatcc

SEQ ID NO: 4157 - DNA, 21 bp, Unknown
  Found in multiple species
gcctataattctcacgggttt

SEQ ID NO: 4158 - DNA, 21 bp, Unknown
  Found in multiple species
gcccttcccgtgacaactgtt

SEQ ID NO: 4159 - DNA, 21 bp, Unknown
  Found in multiple species
gccctgcttgtggtacgactc

SEQ ID NO: 4160 - DNA, 21 bp, Unknown
  Found in multiple species
gccacttcaagatagatgaaa

SEQ ID NO: 4161 - DNA, 21 bp, Unknown
  Found in multiple species
gcatttcatctatcttgaagt

SEQ ID NO: 4162 - DNA, 21 bp, Unknown
  Found in multiple species
gcattcacaggtaccccatgg

SEQ ID NO: 4163 - DNA, 21 bp, Unknown
  Found in multiple species
gcagggcaagtatggttccca

SEQ ID NO: 4164 - DNA, 21 bp, Unknown
  Found in multiple species
gcagatcccggtcaactcgac

SEQ ID NO: 4165 - DNA, 21 bp, Unknown
  Found in multiple species
gcacaaacggggtagttcatc

SEQ ID NO: 4166 - DNA, 21 bp, Unknown
  Found in multiple species
gcaagtatggttcccagattc

SEQ ID NO: 4167 - DNA, 21 bp, Unknown
  Found in multiple species
gcaagtaatcccagcagatcc

SEQ ID NO: 4168 - DNA, 21 bp, Unknown
  Found in multiple species
gcaagataggcaccaataccg

SEQ ID NO: 4169 - DNA, 21 bp, Unknown
  Found in multiple species
gcaacttggtggaccgaagat

SEQ ID NO: 4170 - DNA, 21 bp, Unknown
  Found in multiple species
gcaacctacatgaaatggtct

SEQ ID NO: 4171 - DNA, 21 bp, Unknown
  Found in multiple species
gatttctcggtgtttagaccc

SEQ ID NO: 4172 - DNA, 21 bp, Unknown
  Found in multiple species
gattacttgcataacagtctg

SEQ ID NO: 4173 - DNA, 21 bp, Unknown
  Found in multiple species
gatgcgttgtatacagaggct

SEQ ID NO: 4174 - DNA, 21 bp, Unknown
  Found in multiple species
gatgcggaatctgggaaccat

SEQ ID NO: 4175 - DNA, 21 bp, Unknown
  Found in multiple species
gatgatcttgaaggcatttca

SEQ ID NO: 4176 - DNA, 21 bp, Unknown
  Found in multiple species
gatgaactaccccgtttgtgc

SEQ ID NO: 4177 - DNA, 21 bp, Unknown
  Found in multiple species
gatgaaatgccttcaagatca

SEQ ID NO: 4178 - DNA, 21 bp, Unknown
  Found in multiple species
gatcttgaaggcatttcatct

SEQ ID NO: 4179 - DNA, 21 bp, Unknown
  Found in multiple species
gatctgctgggattacttgca

SEQ ID NO: 4180 - DNA, 21 bp, Unknown
  Found in multiple species
gatcccggtcaactcgactca

SEQ ID NO: 4181 - DNA, 21 bp, Unknown
  Found in multiple species
gatcatcggaaactgtaagat

SEQ ID NO: 4182 - DNA, 21 bp, Unknown
  Found in multiple species
gatagttttgtggaaacctta

SEQ ID NO: 4183 - DNA, 21 bp, Unknown
  Found in multiple species
gataggcaccaataccgaccg

SEQ ID NO: 4184 - DNA, 21 bp, Unknown
  Found in multiple species
gatagcaacctacatgaaatg

SEQ ID NO: 4185 - DNA, 21 bp, Unknown
  Found in multiple species
gatagatgaaatgccttcaag

SEQ ID NO: 4186 - DNA, 21 bp, Unknown
  Found in multiple species
gataaacatgtaccgaacagg

SEQ ID NO: 4187 - DNA, 21 bp, Unknown
  Found in multiple species
gagttgaccgggatctgctgg

SEQ ID NO: 4188 - DNA, 21 bp, Unknown
  Found in multiple species
gagtcgtaccacaagcagggc

SEQ ID NO: 4189 - DNA, 21 bp, Unknown
  Found in multiple species
gagtcgagttgaccgggatct

SEQ ID NO: 4190 - DNA, 21 bp, Unknown
  Found in multiple species
gagggtctaaacaccgagaaa

SEQ ID NO: 4191 - DNA, 21 bp, Unknown
  Found in multiple species
gaggcttgaccagcctataat

SEQ ID NO: 4192 - DNA, 21 bp, Unknown
  Found in multiple species
gagagtcgtaccacaagcagg

SEQ ID NO: 4193 - DNA, 21 bp, Unknown
  Found in multiple species
gagagagtcgtaccacaagca

SEQ ID NO: 4194 - DNA, 21 bp, Unknown
  Found in multiple species
gagaattataggctggtcaag

SEQ ID NO: 4195 - DNA, 21 bp, Unknown
  Found in multiple species
gagaaatcggaagttcaccac

SEQ ID NO: 4196 - DNA, 21 bp, Unknown
  Found in multiple species
gactgttatgcaagtaatccc

SEQ ID NO: 4197 - DNA, 21 bp, Unknown
  Found in multiple species
gaccgggatctgctgggatta

SEQ ID NO: 4198 - DNA, 21 bp, Unknown
  Found in multiple species
gaccatttcatgtaggttgct

SEQ ID NO: 4199 - DNA, 21 bp, Unknown
  Found in multiple species
gaccagcctataattctcacg

SEQ ID NO: 4200 - DNA, 21 bp, Unknown
  Found in multiple species
gaattggaagatagcaaccta

SEQ ID NO: 4201 - DNA, 21 bp, Unknown
  Found in multiple species
gaattataggctggtcaagcc

SEQ ID NO: 4202 - DNA, 21 bp, Unknown
  Found in multiple species
gaatggtagaccatttcatgt

SEQ ID NO: 4203 - DNA, 21 bp, Unknown
  Found in multiple species
gaatctgggaaccatacttgc

SEQ ID NO: 4204 - DNA, 21 bp, Unknown
  Found in multiple species
gaaggcatttcatctatcttg

SEQ ID NO: 4205 - DNA, 21 bp, Unknown
  Found in multiple species
gaaggaatgatcgagattaag

SEQ ID NO: 4206 - DNA, 21 bp, Unknown
  Found in multiple species
gaagatagcaacctacatgaa

SEQ ID NO: 4207 - DNA, 21 bp, Unknown
  Found in multiple species
gaacttctcgagtgtatggga

SEQ ID NO: 4208 - DNA, 21 bp, Unknown
  Found in multiple species
gaacttccgatttctcggtgt

SEQ ID NO: 4209 - DNA, 21 bp, Unknown
  Found in multiple species
gaacttaatctcgatcattcc

SEQ ID NO: 4210 - DNA, 21 bp, Unknown
  Found in multiple species
gaactaccccgtttgtgccca

SEQ ID NO: 4211 - DNA, 21 bp, Unknown
  Found in multiple species
gaacggtcggtattggtgcct

SEQ ID NO: 4212 - DNA, 21 bp, Unknown
  Found in multiple species
gaaccatacttgccctgcttg

SEQ ID NO: 4213 - DNA, 21 bp, Unknown
  Found in multiple species
gaaccaaggaacttctcgagt

SEQ ID NO: 4214 - DNA, 21 bp, Unknown
  Found in multiple species
gaacagttgtcacgggaaggg

SEQ ID NO: 4215 - DNA, 21 bp, Unknown
  Found in multiple species
gaaatgccttcaagatcatcg

SEQ ID NO: 4216 - DNA, 21 bp, Unknown
  Found in multiple species
gaaatcggaagttcaccacct

SEQ ID NO: 4217 - DNA, 21 bp, Unknown
  Found in multiple species
gaaactgtaagatgaactacc

SEQ ID NO: 4218 - DNA, 21 bp, Unknown
  Found in multiple species
cttgggatgcgttgtatacag

SEQ ID NO: 4219 - DNA, 21 bp, Unknown
  Found in multiple species
cttggatgcggaatctgggaa

SEQ ID NO: 4220 - DNA, 21 bp, Unknown
  Found in multiple species
cttgccctgcttgtggtacga

SEQ ID NO: 4221 - DNA, 21 bp, Unknown
  Found in multiple species
cttgagaccgatgagttgttg

SEQ ID NO: 4222 - DNA, 21 bp, Unknown
  Found in multiple species
cttgaccagcctataattctc

SEQ ID NO: 4223 - DNA, 21 bp, Unknown
  Found in multiple species
cttgaaggcatttcatctatc

SEQ ID NO: 4224 - DNA, 21 bp, Unknown
  Found in multiple species
cttctcgagtgtatgggaagg

SEQ ID NO: 4225 - DNA, 21 bp, Unknown
  Found in multiple species
cttctaaggtttccacaaaac

SEQ ID NO: 4226 - DNA, 21 bp, Unknown
  Found in multiple species
cttcggtccaccaagttgcat

SEQ ID NO: 4227 - DNA, 21 bp, Unknown
  Found in multiple species
cttccgatttctcggtgttta

SEQ ID NO: 4228 - DNA, 21 bp, Unknown
  Found in multiple species
cttcccatacactcgagaagt

SEQ ID NO: 4229 - DNA, 21 bp, Unknown
  Found in multiple species
cttccaattcacgataaacat

SEQ ID NO: 4230 - DNA, 21 bp, Unknown
  Found in multiple species
cttcaagatcatcggaaactg

SEQ ID NO: 4231 - DNA, 21 bp, Unknown
  Found in multiple species
cttcaagatagatgaaatgcc

SEQ ID NO: 4232 - DNA, 21 bp, Unknown
  Found in multiple species
cttacagtttccgatgatctt

SEQ ID NO: 4233 - DNA, 21 bp, Unknown
  Found in multiple species
cttaatctcgatcattccttc

SEQ ID NO: 4234 - DNA, 21 bp, Unknown
  Found in multiple species
ctgttcggtacatgtttatcg

SEQ ID NO: 4235 - DNA, 21 bp, Unknown
  Found in multiple species
ctgttatgcaagtaatcccag

SEQ ID NO: 4236 - DNA, 21 bp, Unknown
  Found in multiple species
ctgtcttggatgcggaatctg

SEQ ID NO: 4237 - DNA, 21 bp, Unknown
  Found in multiple species
ctgtatacaacgcatcccaag

SEQ ID NO: 4238 - DNA, 21 bp, Unknown
  Found in multiple species
ctgtaagatgaactaccccgt

SEQ ID NO: 4239 - DNA, 21 bp, Unknown
  Found in multiple species
ctggtcaagcctctgtataca

SEQ ID NO: 4240 - DNA, 21 bp, Unknown
  Found in multiple species
ctgggattacttgcataacag

SEQ ID NO: 4241 - DNA, 21 bp, Unknown
  Found in multiple species
ctgggaaccatacttgccctg

SEQ ID NO: 4242 - DNA, 21 bp, Unknown
  Found in multiple species
ctgcttgtggtacgactctct

SEQ ID NO: 4243 - DNA, 21 bp, Unknown
  Found in multiple species
ctgctgggattacttgcataa

SEQ ID NO: 4244 - DNA, 21 bp, Unknown
  Found in multiple species
ctctgtatacaacgcatccca

SEQ ID NO: 4245 - DNA, 21 bp, Unknown
  Found in multiple species
ctcgagtgtatgggaaggctt

SEQ ID NO: 4246 - DNA, 21 bp, Unknown
  Found in multiple species
ctcatcggtctcaaggaaaaa

SEQ ID NO: 4247 - DNA, 21 bp, Unknown
  Found in multiple species
ctcagccacttcaagatagat

SEQ ID NO: 4248 - DNA, 21 bp, Unknown
  Found in multiple species
ctatcttgaagtggctgagct

SEQ ID NO: 4249 - DNA, 21 bp, Unknown
  Found in multiple species
ctatcttccaattcacgataa

SEQ ID NO: 4250 - DNA, 21 bp, Unknown
  Found in multiple species
ctagtttttccttgagaccga

SEQ ID NO: 4251 - DNA, 21 bp, Unknown
  Found in multiple species
ctacatgaaatggtctaccat

SEQ ID NO: 4252 - DNA, 21 bp, Unknown
  Found in multiple species
ctaaggtttccacaaaactat

SEQ ID NO: 4253 - DNA, 21 bp, Unknown
  Found in multiple species
ctaaacaccgagaaatcggaa

SEQ ID NO: 4254 - DNA, 21 bp, Unknown
  Found in multiple species
cgttgtatacagaggcttgac

SEQ ID NO: 4255 - DNA, 21 bp, Unknown
  Found in multiple species
cgtgagaattataggctggtc

SEQ ID NO: 4256 - DNA, 21 bp, Unknown
  Found in multiple species
cgtgaattggaagatagcaac

SEQ ID NO: 4257 - DNA, 21 bp, Unknown
  Found in multiple species
cgtaccacaagcagggcaagt

SEQ ID NO: 4258 - DNA, 21 bp, Unknown
  Found in multiple species
cggtctcaaggaaaaactagc

SEQ ID NO: 4259 - DNA, 21 bp, Unknown
  Found in multiple species
cggtcggtattggtgcctatc

SEQ ID NO: 4260 - DNA, 21 bp, Unknown
  Found in multiple species
cggtccaccaagttgcatgtg

SEQ ID NO: 4261 - DNA, 21 bp, Unknown
  Found in multiple species
cggtattggtgcctatcttgc

SEQ ID NO: 4262 - DNA, 21 bp, Unknown
  Found in multiple species
cggtacatgtttatcgtgaat

SEQ ID NO: 4263 - DNA, 21 bp, Unknown
  Found in multiple species
cggggtagttcatcttacagt

SEQ ID NO: 4264 - DNA, 21 bp, Unknown
  Found in multiple species
cgggatctgctgggattactt

SEQ ID NO: 4265 - DNA, 21 bp, Unknown
  Found in multiple species
cggaatctgggaaccatactt

SEQ ID NO: 4266 - DNA, 21 bp, Unknown
  Found in multiple species
cggaaactgtaagatgaacta

SEQ ID NO: 4267 - DNA, 21 bp, Unknown
  Found in multiple species
cgatttctcggtgtttagacc

SEQ ID NO: 4268 - DNA, 21 bp, Unknown
  Found in multiple species
cgatgatcttgaaggcatttc

SEQ ID NO: 4269 - DNA, 21 bp, Unknown
  Found in multiple species
cgataaacatgtaccgaacag

SEQ ID NO: 4270 - DNA, 21 bp, Unknown
  Found in multiple species
cgagttgaccgggatctgctg

SEQ ID NO: 4271 - DNA, 21 bp, Unknown
  Found in multiple species
cgagtgtatgggaaggcttga

SEQ ID NO: 4272 - DNA, 21 bp, Unknown
  Found in multiple species
cgagaaatcggaagttcacca

SEQ ID NO: 4273 - DNA, 21 bp, Unknown
  Found in multiple species
cgaacagttgtcacgggaagg

SEQ ID NO: 4274 - DNA, 21 bp, Unknown
  Found in multiple species
ccttgagaccgatgagttgtt

SEQ ID NO: 4275 - DNA, 21 bp, Unknown
  Found in multiple species
ccttctaaggtttccacaaaa

SEQ ID NO: 4276 - DNA, 21 bp, Unknown
  Found in multiple species
ccttcccgtgacaactgttcg

SEQ ID NO: 4277 - DNA, 21 bp, Unknown
  Found in multiple species
ccttcccatacactcgagaag

SEQ ID NO: 4278 - DNA, 21 bp, Unknown
  Found in multiple species
ccttcaagatcatcggaaact

SEQ ID NO: 4279 - DNA, 21 bp, Unknown
  Found in multiple species
cctgttcggtacatgtttatc

SEQ ID NO: 4280 - DNA, 21 bp, Unknown
  Found in multiple species
cctgcttgtggtacgactctc

SEQ ID NO: 4281 - DNA, 21 bp, Unknown
  Found in multiple species
cctctgtatacaacgcatccc

SEQ ID NO: 4282 - DNA, 21 bp, Unknown
  Found in multiple species
cctataattctcacgggtttt

SEQ ID NO: 4283 - DNA, 21 bp, Unknown
  Found in multiple species
cctacatgaaatggtctacca

SEQ ID NO: 4284 - DNA, 21 bp, Unknown
  Found in multiple species
ccgtgagaattataggctggt

SEQ ID NO: 4285 - DNA, 21 bp, Unknown
  Found in multiple species
ccgggatctgctgggattact

SEQ ID NO: 4286 - DNA, 21 bp, Unknown
  Found in multiple species
ccgatttctcggtgtttagac

SEQ ID NO: 4287 - DNA, 21 bp, Unknown
  Found in multiple species
ccgatgatcttgaaggcattt

SEQ ID NO: 4288 - DNA, 21 bp, Unknown
  Found in multiple species
ccgagaaatcggaagttcacc

SEQ ID NO: 4289 - DNA, 21 bp, Unknown
  Found in multiple species
cccttcccgtgacaactgttc

SEQ ID NO: 4290 - DNA, 21 bp, Unknown
  Found in multiple species
ccctgcttgtggtacgactct

SEQ ID NO: 4291 - DNA, 21 bp, Unknown
  Found in multiple species
cccgtgagaattataggctgg

SEQ ID NO: 4292 - DNA, 21 bp, Unknown
  Found in multiple species
ccccaccatggggtacctgtg

SEQ ID NO: 4293 - DNA, 21 bp, Unknown
  Found in multiple species
cccatacactcgagaagttcc

SEQ ID NO: 4294 - DNA, 21 bp, Unknown
  Found in multiple species
cccagcagatcccggtcaact

SEQ ID NO: 4295 - DNA, 21 bp, Unknown
  Found in multiple species
cccagattccgcatccaagac

SEQ ID NO: 4296 - DNA, 21 bp, Unknown
  Found in multiple species
cccaccatggggtacctgtga

SEQ ID NO: 4297 - DNA, 21 bp, Unknown
  Found in multiple species
ccatttcatgtaggttgctat

SEQ ID NO: 4298 - DNA, 21 bp, Unknown
  Found in multiple species
ccatggggtacctgtgaatgc

SEQ ID NO: 4299 - DNA, 21 bp, Unknown
  Found in multiple species
ccatacttgccctgcttgtgg

SEQ ID NO: 4300 - DNA, 21 bp, Unknown
  Found in multiple species
ccatacactcgagaagttcct

SEQ ID NO: 4301 - DNA, 21 bp, Unknown
  Found in multiple species
ccagcctataattctcacggg

SEQ ID NO: 4302 - DNA, 21 bp, Unknown
  Found in multiple species
ccagcagatcccggtcaactc

SEQ ID NO: 4303 - DNA, 21 bp, Unknown
  Found in multiple species
ccagattccgcatccaagaca

SEQ ID NO: 4304 - DNA, 21 bp, Unknown
  Found in multiple species
ccacttcaagatagatgaaat

SEQ ID NO: 4305 - DNA, 21 bp, Unknown
  Found in multiple species
ccaccatggggtacctgtgaa

SEQ ID NO: 4306 - DNA, 21 bp, Unknown
  Found in multiple species
ccaccaagttgcatgtgtgaa

SEQ ID NO: 4307 - DNA, 21 bp, Unknown
  Found in multiple species
ccacaagcagggcaagtatgg

SEQ ID NO: 4308 - DNA, 21 bp, Unknown
  Found in multiple species
ccaattcacgataaacatgta

SEQ ID NO: 4309 - DNA, 21 bp, Unknown
  Found in multiple species
ccaaggaacttctcgagtgta

SEQ ID NO: 4310 - DNA, 21 bp, Unknown
  Found in multiple species
catttcatgtaggttgctatc

SEQ ID NO: 4311 - DNA, 21 bp, Unknown
  Found in multiple species
catttcatctatcttgaagtg

SEQ ID NO: 4312 - DNA, 21 bp, Unknown
  Found in multiple species
cattcacaggtaccccatggt

SEQ ID NO: 4313 - DNA, 21 bp, Unknown
  Found in multiple species
catgtttatcgtgaattggaa

SEQ ID NO: 4314 - DNA, 21 bp, Unknown
  Found in multiple species
catgtaggttgctatcttcca

SEQ ID NO: 4315 - DNA, 21 bp, Unknown
  Found in multiple species
catggggtacctgtgaatgca

SEQ ID NO: 4316 - DNA, 21 bp, Unknown
  Found in multiple species
catgcaacttggtggaccgaa

SEQ ID NO: 4317 - DNA, 21 bp, Unknown
  Found in multiple species
catgaaatggtctaccattca

SEQ ID NO: 4318 - DNA, 21 bp, Unknown
  Found in multiple species
catcttacagtttccgatgat

SEQ ID NO: 4319 - DNA, 21 bp, Unknown
  Found in multiple species
catctatcttgaagtggctga

SEQ ID NO: 4320 - DNA, 21 bp, Unknown
  Found in multiple species
catcggtctcaaggaaaaact

SEQ ID NO: 4321 - DNA, 21 bp, Unknown
  Found in multiple species
catcggaaactgtaagatgaa

SEQ ID NO: 4322 - DNA, 21 bp, Unknown
  Found in multiple species
catacttgccctgcttgtggt

SEQ ID NO: 4323 - DNA, 21 bp, Unknown
  Found in multiple species
catacactcgagaagttcctt

SEQ ID NO: 4324 - DNA, 21 bp, Unknown
  Found in multiple species
cagtttccgatgatcttgaag

SEQ ID NO: 4325 - DNA, 21 bp, Unknown
  Found in multiple species
cagttgtcacgggaagggcta

SEQ ID NO: 4326 - DNA, 21 bp, Unknown
  Found in multiple species
caggtggtgaacttccgattt

SEQ ID NO: 4327 - DNA, 21 bp, Unknown
  Found in multiple species
cagggcaagtatggttcccag

SEQ ID NO: 4328 - DNA, 21 bp, Unknown
  Found in multiple species
cagcctataattctcacgggt

SEQ ID NO: 4329 - DNA, 21 bp, Unknown
  Found in multiple species
cagccacttcaagatagatga

SEQ ID NO: 4330 - DNA, 21 bp, Unknown
  Found in multiple species
cagcagatcccggtcaactcg

SEQ ID NO: 4331 - DNA, 21 bp, Unknown
  Found in multiple species
cagattccgcatccaagacag

SEQ ID NO: 4332 - DNA, 21 bp, Unknown
  Found in multiple species
cagatcccggtcaactcgact

SEQ ID NO: 4333 - DNA, 21 bp, Unknown
  Found in multiple species
cagaggcttgaccagcctata

SEQ ID NO: 4334 - DNA, 21 bp, Unknown
  Found in multiple species
cagactgttatgcaagtaatc

SEQ ID NO: 4335 - DNA, 21 bp, Unknown
  Found in multiple species
cacttcaagatagatgaaatg

SEQ ID NO: 4336 - DNA, 21 bp, Unknown
  Found in multiple species
cactcgagaagttccttggtt

SEQ ID NO: 4337 - DNA, 21 bp, Unknown
  Found in multiple species
cacgataaacatgtaccgaac

SEQ ID NO: 4338 - DNA, 21 bp, Unknown
  Found in multiple species
caccgagaaatcggaagttca

SEQ ID NO: 4339 - DNA, 21 bp, Unknown
  Found in multiple species
caccatggggtacctgtgaat

SEQ ID NO: 4340 - DNA, 21 bp, Unknown
  Found in multiple species
caccaagttgcatgtgtgaac

SEQ ID NO: 4341 - DNA, 21 bp, Unknown
  Found in multiple species
cacatgcaacttggtggaccg

SEQ ID NO: 4342 - DNA, 21 bp, Unknown
  Found in multiple species
cacaggtaccccatggtgggg

SEQ ID NO: 4343 - DNA, 21 bp, Unknown
  Found in multiple species
cacacatgcaacttggtggac

SEQ ID NO: 4344 - DNA, 21 bp, Unknown
  Found in multiple species
cacaagcagggcaagtatggt

SEQ ID NO: 4345 - DNA, 21 bp, Unknown
  Found in multiple species
cacaaacggggtagttcatct

SEQ ID NO: 4346 - DNA, 21 bp, Unknown
  Found in multiple species
caattcacgataaacatgtac

SEQ ID NO: 4347 - DNA, 21 bp, Unknown
  Found in multiple species
caagtatggttcccagattcc

SEQ ID NO: 4348 - DNA, 21 bp, Unknown
  Found in multiple species
caagtaatcccagcagatccc

SEQ ID NO: 4349 - DNA, 21 bp, Unknown
  Found in multiple species
caaggaacttctcgagtgtat

SEQ ID NO: 4350 - DNA, 21 bp, Unknown
  Found in multiple species
caagccttcccatacactcga

SEQ ID NO: 4351 - DNA, 21 bp, Unknown
  Found in multiple species
caagcctctgtatacaacgca

SEQ ID NO: 4352 - DNA, 21 bp, Unknown
  Found in multiple species
caagcagggcaagtatggttc

SEQ ID NO: 4353 - DNA, 21 bp, Unknown
  Found in multiple species
caagatcatcggaaactgtaa

SEQ ID NO: 4354 - DNA, 21 bp, Unknown
  Found in multiple species
caagataggcaccaataccga

SEQ ID NO: 4355 - DNA, 21 bp, Unknown
  Found in multiple species
caagatagatgaaatgccttc

SEQ ID NO: 4356 - DNA, 21 bp, Unknown
  Found in multiple species
caactcatcggtctcaaggaa

SEQ ID NO: 4357 - DNA, 21 bp, Unknown
  Found in multiple species
caacctacatgaaatggtcta

SEQ ID NO: 4358 - DNA, 21 bp, Unknown
  Found in multiple species
caacaactcatcggtctcaag

SEQ ID NO: 4359 - DNA, 21 bp, Unknown
  Found in multiple species
caaacggggtagttcatctta

SEQ ID NO: 4360 - DNA, 21 bp, Unknown
  Found in multiple species
attttcaggcaaatacgcaac

SEQ ID NO: 4361 - DNA, 21 bp, Unknown
  Found in multiple species
atttctcggtgtttagaccct

SEQ ID NO: 4362 - DNA, 21 bp, Unknown
  Found in multiple species
atttcatgtaggttgctatct

SEQ ID NO: 4363 - DNA, 21 bp, Unknown
  Found in multiple species
atttcatctatcttgaagtgg

SEQ ID NO: 4364 - DNA, 21 bp, Unknown
  Found in multiple species
attggaagatagcaacctaca

SEQ ID NO: 4365 - DNA, 21 bp, Unknown
  Found in multiple species
attcacgataaacatgtaccg

SEQ ID NO: 4366 - DNA, 21 bp, Unknown
  Found in multiple species
attcacaggtaccccatggtg

SEQ ID NO: 4367 - DNA, 21 bp, Unknown
  Found in multiple species
attataggctggtcaagcctc

SEQ ID NO: 4368 - DNA, 21 bp, Unknown
  Found in multiple species
atgtttatcgtgaattggaag

SEQ ID NO: 4369 - DNA, 21 bp, Unknown
  Found in multiple species
atgtaggttgctatcttccaa

SEQ ID NO: 4370 - DNA, 21 bp, Unknown
  Found in multiple species
atggttcccagattccgcatc

SEQ ID NO: 4371 - DNA, 21 bp, Unknown
  Found in multiple species
atggtagaccatttcatgtag

SEQ ID NO: 4372 - DNA, 21 bp, Unknown
  Found in multiple species
atggggtacctgtgaatgcac

SEQ ID NO: 4373 - DNA, 21 bp, Unknown
  Found in multiple species
atgggcacaaacggggtagtt

SEQ ID NO: 4374 - DNA, 21 bp, Unknown
  Found in multiple species
atgcgttgtatacagaggctt

SEQ ID NO: 4375 - DNA, 21 bp, Unknown
  Found in multiple species
atgcggaatctgggaaccata

SEQ ID NO: 4376 - DNA, 21 bp, Unknown
  Found in multiple species
atgccttcaagatcatcggaa

SEQ ID NO: 4377 - DNA, 21 bp, Unknown
  Found in multiple species
atgcaagtaatcccagcagat

SEQ ID NO: 4378 - DNA, 21 bp, Unknown
  Found in multiple species
atgcaacttggtggaccgaag

SEQ ID NO: 4379 - DNA, 21 bp, Unknown
  Found in multiple species
atgatcttgaaggcatttcat

SEQ ID NO: 4380 - DNA, 21 bp, Unknown
  Found in multiple species
atgaactaccccgtttgtgcc

SEQ ID NO: 4381 - DNA, 21 bp, Unknown
  Found in multiple species
atgaaatgccttcaagatcat

SEQ ID NO: 4382 - DNA, 21 bp, Unknown
  Found in multiple species
atcttgaaggcatttcatcta

SEQ ID NO: 4383 - DNA, 21 bp, Unknown
  Found in multiple species
atcttcggtccaccaagttgc

SEQ ID NO: 4384 - DNA, 21 bp, Unknown
  Found in multiple species
atcttccaattcacgataaac

SEQ ID NO: 4385 - DNA, 21 bp, Unknown
  Found in multiple species
atcttacagtttccgatgatc

SEQ ID NO: 4386 - DNA, 21 bp, Unknown
  Found in multiple species
atctgggaaccatacttgccc

SEQ ID NO: 4387 - DNA, 21 bp, Unknown
  Found in multiple species
atctgctgggattacttgcat

SEQ ID NO: 4388 - DNA, 21 bp, Unknown
  Found in multiple species
atctatcttgaagtggctgag

SEQ ID NO: 4389 - DNA, 21 bp, Unknown
  Found in multiple species
atcgtgaattggaagatagca

SEQ ID NO: 4390 - DNA, 21 bp, Unknown
  Found in multiple species
atcggtctcaaggaaaaacta

SEQ ID NO: 4391 - DNA, 21 bp, Unknown
  Found in multiple species
atcggaaactgtaagatgaac

SEQ ID NO: 4392 - DNA, 21 bp, Unknown
  Found in multiple species
atcccggtcaactcgactcac

SEQ ID NO: 4393 - DNA, 21 bp, Unknown
  Found in multiple species
atcccagcagatcccggtcaa

SEQ ID NO: 4394 - DNA, 21 bp, Unknown
  Found in multiple species
atcatcggaaactgtaagatg

SEQ ID NO: 4395 - DNA, 21 bp, Unknown
  Found in multiple species
atagttttgtggaaaccttag

SEQ ID NO: 4396 - DNA, 21 bp, Unknown
  Found in multiple species
ataggctggtcaagcctctgt

SEQ ID NO: 4397 - DNA, 21 bp, Unknown
  Found in multiple species
ataggcaccaataccgaccgt

SEQ ID NO: 4398 - DNA, 21 bp, Unknown
  Found in multiple species
atagcaacctacatgaaatgg

SEQ ID NO: 4399 - DNA, 21 bp, Unknown
  Found in multiple species
atagatgaaatgccttcaaga

SEQ ID NO: 4400 - DNA, 21 bp, Unknown
  Found in multiple species
atacttgccctgcttgtggta

SEQ ID NO: 4401 - DNA, 21 bp, Unknown
  Found in multiple species
atacagaggcttgaccagcct

SEQ ID NO: 4402 - DNA, 21 bp, Unknown
  Found in multiple species
atacactcgagaagttccttg

SEQ ID NO: 4403 - DNA, 21 bp, Unknown
  Found in multiple species
ataaacatgtaccgaacaggt

SEQ ID NO: 4404 - DNA, 21 bp, Unknown
  Found in multiple species
agtttttccttgagaccgatg

SEQ ID NO: 4405 - DNA, 21 bp, Unknown
  Found in multiple species
agttttgtggaaaccttagaa

SEQ ID NO: 4406 - DNA, 21 bp, Unknown
  Found in multiple species
agtttccgatgatcttgaagg

SEQ ID NO: 4407 - DNA, 21 bp, Unknown
  Found in multiple species
agtttagcccttcccgtgaca

SEQ ID NO: 4408 - DNA, 21 bp, Unknown
  Found in multiple species
agttgtcacgggaagggctaa

SEQ ID NO: 4409 - DNA, 21 bp, Unknown
  Found in multiple species
agttgaccgggatctgctggg

SEQ ID NO: 4410 - DNA, 21 bp, Unknown
  Found in multiple species
agttcatcttacagtttccga

SEQ ID NO: 4411 - DNA, 21 bp, Unknown
  Found in multiple species
agttcacacatgcaacttggt

SEQ ID NO: 4412 - DNA, 21 bp, Unknown
  Found in multiple species
agtcgtaccacaagcagggca

SEQ ID NO: 4413 - DNA, 21 bp, Unknown
  Found in multiple species
agtcgagttgaccgggatctg

SEQ ID NO: 4414 - DNA, 21 bp, Unknown
  Found in multiple species
agtatggttcccagattccgc

SEQ ID NO: 4415 - DNA, 21 bp, Unknown
  Found in multiple species
agtaatcccagcagatcccgg

SEQ ID NO: 4416 - DNA, 21 bp, Unknown
  Found in multiple species
aggttgctatcttccaattca

SEQ ID NO: 4417 - DNA, 21 bp, Unknown
  Found in multiple species
aggtggtgaacttccgatttc

SEQ ID NO: 4418 - DNA, 21 bp, Unknown
  Found in multiple species
agggtgcattcacaggtaccc

SEQ ID NO: 4419 - DNA, 21 bp, Unknown
  Found in multiple species
agggtctaaacaccgagaaat

SEQ ID NO: 4420 - DNA, 21 bp, Unknown
  Found in multiple species
agggcaagtatggttcccaga

SEQ ID NO: 4421 - DNA, 21 bp, Unknown
  Found in multiple species
aggcttgaccagcctataatt

SEQ ID NO: 4422 - DNA, 21 bp, Unknown
  Found in multiple species
aggctggtcaagcctctgtat

SEQ ID NO: 4423 - DNA, 21 bp, Unknown
  Found in multiple species
aggcatttcatctatcttgaa

SEQ ID NO: 4424 - DNA, 21 bp, Unknown
  Found in multiple species
aggcaccaataccgaccgttc

SEQ ID NO: 4425 - DNA, 21 bp, Unknown
  Found in multiple species
aggaatgatcgagattaagtt

SEQ ID NO: 4426 - DNA, 21 bp, Unknown
  Found in multiple species
aggaacttctcgagtgtatgg

SEQ ID NO: 4427 - DNA, 21 bp, Unknown
  Found in multiple species
agctcagccacttcaagatag

SEQ ID NO: 4428 - DNA, 21 bp, Unknown
  Found in multiple species
agccttcccatacactcgaga

SEQ ID NO: 4429 - DNA, 21 bp, Unknown
  Found in multiple species
agcctctgtatacaacgcatc

SEQ ID NO: 4430 - DNA, 21 bp, Unknown
  Found in multiple species
agcctataattctcacgggtt

SEQ ID NO: 4431 - DNA, 21 bp, Unknown
  Found in multiple species
agcccttcccgtgacaactgt

SEQ ID NO: 4432 - DNA, 21 bp, Unknown
  Found in multiple species
agccacttcaagatagatgaa

SEQ ID NO: 4433 - DNA, 21 bp, Unknown
  Found in multiple species
agccaagagctctaattccta

SEQ ID NO: 4434 - DNA, 21 bp, Unknown
  Found in multiple species
agcagggcaagtatggttccc

SEQ ID NO: 4435 - DNA, 21 bp, Unknown
  Found in multiple species
agcagatcccggtcaactcga

SEQ ID NO: 4436 - DNA, 21 bp, Unknown
  Found in multiple species
agcaacctacatgaaatggtc

SEQ ID NO: 4437 - DNA, 21 bp, Unknown
  Found in multiple species
agatgaactaccccgtttgtg

SEQ ID NO: 4438 - DNA, 21 bp, Unknown
  Found in multiple species
agatgaaatgccttcaagatc

SEQ ID NO: 4439 - DNA, 21 bp, Unknown
  Found in multiple species
agatcccggtcaactcgactc

SEQ ID NO: 4440 - DNA, 21 bp, Unknown
  Found in multiple species
agatcatcggaaactgtaaga

SEQ ID NO: 4441 - DNA, 21 bp, Unknown
  Found in multiple species
agataggcaccaataccgacc

SEQ ID NO: 4442 - DNA, 21 bp, Unknown
  Found in multiple species
agatagcaacctacatgaaat

SEQ ID NO: 4443 - DNA, 21 bp, Unknown
  Found in multiple species
agatagatgaaatgccttcaa

SEQ ID NO: 4444 - DNA, 21 bp, Unknown
  Found in multiple species
agagtcgtaccacaagcaggg

SEQ ID NO: 4445 - DNA, 21 bp, Unknown
  Found in multiple species
agaggcttgaccagcctataa

SEQ ID NO: 4446 - DNA, 21 bp, Unknown
  Found in multiple species
agagagtcgtaccacaagcag

SEQ ID NO: 4447 - DNA, 21 bp, Unknown
  Found in multiple species
agactgttatgcaagtaatcc

SEQ ID NO: 4448 - DNA, 21 bp, Unknown
  Found in multiple species
agaccatttcatgtaggttgc

SEQ ID NO: 4449 - DNA, 21 bp, Unknown
  Found in multiple species
agaattataggctggtcaagc

SEQ ID NO: 4450 - DNA, 21 bp, Unknown
  Found in multiple species
agaacggtcggtattggtgcc

SEQ ID NO: 4451 - DNA, 21 bp, Unknown
  Found in multiple species
agaaatcggaagttcaccacc

SEQ ID NO: 4452 - DNA, 21 bp, Unknown
  Found in multiple species
acttgccctgcttgtggtacg

SEQ ID NO: 4453 - DNA, 21 bp, Unknown
  Found in multiple species
acttctcgagtgtatgggaag

SEQ ID NO: 4454 - DNA, 21 bp, Unknown
  Found in multiple species
acttccgatttctcggtgttt

SEQ ID NO: 4455 - DNA, 21 bp, Unknown
  Found in multiple species
acttcaagatagatgaaatgc

SEQ ID NO: 4456 - DNA, 21 bp, Unknown
  Found in multiple species
acttaatctcgatcattcctt

SEQ ID NO: 4457 - DNA, 21 bp, Unknown
  Found in multiple species
actgttatgcaagtaatccca

SEQ ID NO: 4458 - DNA, 21 bp, Unknown
  Found in multiple species
actgtaagatgaactaccccg

SEQ ID NO: 4459 - DNA, 21 bp, Unknown
  Found in multiple species
actcgagaagttccttggttc

SEQ ID NO: 4460 - DNA, 21 bp, Unknown
  Found in multiple species
actcatcggtctcaaggaaaa

SEQ ID NO: 4461 - DNA, 21 bp, Unknown
  Found in multiple species
acggtcggtattggtgcctat

SEQ ID NO: 4462 - DNA, 21 bp, Unknown
  Found in multiple species
acggggtagttcatcttacag

SEQ ID NO: 4463 - DNA, 21 bp, Unknown
  Found in multiple species
acgataaacatgtaccgaaca

SEQ ID NO: 4464 - DNA, 21 bp, Unknown
  Found in multiple species
acctgttcggtacatgtttat

SEQ ID NO: 4465 - DNA, 21 bp, Unknown
  Found in multiple species
acctacatgaaatggtctacc

SEQ ID NO: 4466 - DNA, 21 bp, Unknown
  Found in multiple species
accgggatctgctgggattac

SEQ ID NO: 4467 - DNA, 21 bp, Unknown
  Found in multiple species
accgagaaatcggaagttcac

SEQ ID NO: 4468 - DNA, 21 bp, Unknown
  Found in multiple species
acccgtgagaattataggctg

SEQ ID NO: 4469 - DNA, 21 bp, Unknown
  Found in multiple species
accatttcatgtaggttgcta

SEQ ID NO: 4470 - DNA, 21 bp, Unknown
  Found in multiple species
accatggggtacctgtgaatg

SEQ ID NO: 4471 - DNA, 21 bp, Unknown
  Found in multiple species
accatacttgccctgcttgtg

SEQ ID NO: 4472 - DNA, 21 bp, Unknown
  Found in multiple species
accagcctataattctcacgg

SEQ ID NO: 4473 - DNA, 21 bp, Unknown
  Found in multiple species
accacaagcagggcaagtatg

SEQ ID NO: 4474 - DNA, 21 bp, Unknown
  Found in multiple species
accaagttgcatgtgtgaact

SEQ ID NO: 4475 - DNA, 21 bp, Unknown
  Found in multiple species
accaaggaacttctcgagtgt

SEQ ID NO: 4476 - DNA, 21 bp, Unknown
  Found in multiple species
acatgtttatcgtgaattgga

SEQ ID NO: 4477 - DNA, 21 bp, Unknown
  Found in multiple species
acatgcaacttggtggaccga

SEQ ID NO: 4478 - DNA, 21 bp, Unknown
  Found in multiple species
acatgaaatggtctaccattc

SEQ ID NO: 4479 - DNA, 21 bp, Unknown
  Found in multiple species
acagtttccgatgatcttgaa

SEQ ID NO: 4480 - DNA, 21 bp, Unknown
  Found in multiple species
acagttgtcacgggaagggct

SEQ ID NO: 4481 - DNA, 21 bp, Unknown
  Found in multiple species
acagaggcttgaccagcctat

SEQ ID NO: 4482 - DNA, 21 bp, Unknown
  Found in multiple species
acactcgagaagttccttggt

SEQ ID NO: 4483 - DNA, 21 bp, Unknown
  Found in multiple species
acaccgagaaatcggaagttc

SEQ ID NO: 4484 - DNA, 21 bp, Unknown
  Found in multiple species
acacatgcaacttggtggacc

SEQ ID NO: 4485 - DNA, 21 bp, Unknown
  Found in multiple species
acaagcagggcaagtatggtt

SEQ ID NO: 4486 - DNA, 21 bp, Unknown
  Found in multiple species
acaactcatcggtctcaagga

SEQ ID NO: 4487 - DNA, 21 bp, Unknown
  Found in multiple species
acaaacggggtagttcatctt

SEQ ID NO: 4488 - DNA, 21 bp, Unknown
  Found in multiple species
aattttcaggcaaatacgcaa

SEQ ID NO: 4489 - DNA, 21 bp, Unknown
  Found in multiple species
aattggaagatagcaacctac

SEQ ID NO: 4490 - DNA, 21 bp, Unknown
  Found in multiple species
aattcacgataaacatgtacc

SEQ ID NO: 4491 - DNA, 21 bp, Unknown
  Found in multiple species
aattataggctggtcaagcct

SEQ ID NO: 4492 - DNA, 21 bp, Unknown
  Found in multiple species
aatggtagaccatttcatgta

SEQ ID NO: 4493 - DNA, 21 bp, Unknown
  Found in multiple species
aatgccttcaagatcatcgga

SEQ ID NO: 4494 - DNA, 21 bp, Unknown
  Found in multiple species
aatctgggaaccatacttgcc

SEQ ID NO: 4495 - DNA, 21 bp, Unknown
  Found in multiple species
aatcccagcagatcccggtca

SEQ ID NO: 4496 - DNA, 21 bp, Unknown
  Found in multiple species
aagtatggttcccagattccg

SEQ ID NO: 4497 - DNA, 21 bp, Unknown
  Found in multiple species
aagtaatcccagcagatcccg

SEQ ID NO: 4498 - DNA, 21 bp, Unknown
  Found in multiple species
aaggcatttcatctatcttga

SEQ ID NO: 4499 - DNA, 21 bp, Unknown
  Found in multiple species
aaggaatgatcgagattaagt

SEQ ID NO: 4500 - DNA, 21 bp, Unknown
  Found in multiple species
aaggaacttctcgagtgtatg

SEQ ID NO: 4501 - DNA, 21 bp, Unknown
  Found in multiple species
aagccttcccatacactcgag

SEQ ID NO: 4502 - DNA, 21 bp, Unknown
  Found in multiple species
aagcctctgtatacaacgcat

SEQ ID NO: 4503 - DNA, 21 bp, Unknown
  Found in multiple species
aagcagggcaagtatggttcc

SEQ ID NO: 4504 - DNA, 21 bp, Unknown
  Found in multiple species
aagatgaactaccccgtttgt

SEQ ID NO: 4505 - DNA, 21 bp, Unknown
  Found in multiple species
aagatcatcggaaactgtaag

SEQ ID NO: 4506 - DNA, 21 bp, Unknown
  Found in multiple species
aagataggcaccaataccgac

SEQ ID NO: 4507 - DNA, 21 bp, Unknown
  Found in multiple species
aagatagcaacctacatgaaa

SEQ ID NO: 4508 - DNA, 21 bp, Unknown
  Found in multiple species
aagatagatgaaatgccttca

SEQ ID NO: 4509 - DNA, 21 bp, Unknown
  Found in multiple species
aacttctcgagtgtatgggaa

SEQ ID NO: 4510 - DNA, 21 bp, Unknown
  Found in multiple species
aacttccgatttctcggtgtt

SEQ ID NO: 4511 - DNA, 21 bp, Unknown
  Found in multiple species
aacttaatctcgatcattcct

SEQ ID NO: 4512 - DNA, 21 bp, Unknown
  Found in multiple species
aactgtaagatgaactacccc

SEQ ID NO: 4513 - DNA, 21 bp, Unknown
  Found in multiple species
aactcatcggtctcaaggaaa

SEQ ID NO: 4514 - DNA, 21 bp, Unknown
  Found in multiple species
aactaccccgtttgtgcccat

SEQ ID NO: 4515 - DNA, 21 bp, Unknown
  Found in multiple species
aacggtcggtattggtgccta

SEQ ID NO: 4516 - DNA, 21 bp, Unknown
  Found in multiple species
aacggggtagttcatcttaca

SEQ ID NO: 4517 - DNA, 21 bp, Unknown
  Found in multiple species
aacctacatgaaatggtctac

SEQ ID NO: 4518 - DNA, 21 bp, Unknown
  Found in multiple species
aacccgtgagaattataggct

SEQ ID NO: 4519 - DNA, 21 bp, Unknown
  Found in multiple species
aaccatacttgccctgcttgt

SEQ ID NO: 4520 - DNA, 21 bp, Unknown
  Found in multiple species
aaccaaggaacttctcgagtg

SEQ ID NO: 4521 - DNA, 21 bp, Unknown
  Found in multiple species
aacagttgtcacgggaagggc

SEQ ID NO: 4522 - DNA, 21 bp, Unknown
  Found in multiple species
aacaccgagaaatcggaagtt

SEQ ID NO: 4523 - DNA, 21 bp, Unknown
  Found in multiple species
aacaactcatcggtctcaagg

SEQ ID NO: 4524 - DNA, 21 bp, Unknown
  Found in multiple species
aaatgccttcaagatcatcgg

SEQ ID NO: 4525 - DNA, 21 bp, Unknown
  Found in multiple species
aaatcggaagttcaccacctg

SEQ ID NO: 4526 - DNA, 21 bp, Unknown
  Found in multiple species
aaactgtaagatgaactaccc

SEQ ID NO: 4527 - DNA, 21 bp, Unknown
  Found in multiple species
aaacggggtagttcatcttac

SEQ ID NO: 4528 - DNA, 21 bp, Unknown
  Found in multiple species
aaacccgtgagaattataggc

SEQ ID NO: 4529 - DNA, 21 bp, Unknown
  Found in multiple species
aaacaccgagaaatcggaagt

SEQ ID NO: 4530 - DNA, 21 bp, Unknown
  Found in multiple species
aaaacccgtgagaattatagg

SEQ ID NO: 4531 - DNA, 19 bp, Amaranthus palmeri
gtcttacaagggttctcaa

SEQ ID NO: 4532 - DNA, 21 bp, Amaranthus palmeri
atctatgttcacctccctgtg

SEQ ID NO: 4533 - DNA, 21 bp, Amaranthus palmeri
ataaaccattagctttcccgg

SEQ ID NO: 4534 - DNA, 21 bp, Amaranthus palmeri
tttattggaacaagcggagtt

SEQ ID NO: 4535 - DNA, 21 bp, Amaranthus palmeri
tatagcaccacttcccgatag

SEQ ID NO: 4536 - DNA, 21 bp, Amaranthus palmeri
gcaccacgaggatcacaagaa

SEQ ID NO: 4537 - DNA, 21 bp, Amaranthus palmeri
ccacccgagaaacctctccaa

SEQ ID NO: 4538 - DNA, 21 bp, Amaranthus palmeri
cagtcttgacgagtgattcct

We claim:

1. A method for potentiating activity of an acetyl-CoA carboxylase (ACCase) inhibitor herbicide in a plant comprising
   (a) applying to a surface of the plant a composition comprising at least one non-transcribable polynucleotide and a transfer agent,
      wherein the at least one non-transcribable polynucleotide is from 21 to about 700 nucleotides in length and is identical or complementary to at least 21 contiguous nucleotides of an ACCase gene sequence or an RNA sequence thereof,
      wherein the ACCase gene sequence is selected from the group consisting of SEQ ID NOs: 1, 5, 6, 11, 12, 16-18, 22-24, 26, 27, 32, 34-74, 79, 81-104, 109-116, 121-132, 135, 136, 139-150, 153-166, 171-180, 183-186, 189-326, 337-344, 347-360, 363-366, 369, 370, 373, 374, 377-380, 383-414, 425-432, 435-448, 451-454, 457, 458, 461, 462, 465-556, 567-572, 575-596, 601, 602, 607, 608, 611, 612, 615-618, 621, 622, 625-628, 631-694, 701-704, 707, 708, 711-722, 725-750, 753, 754, 757-768, 773, 774, 779-784, 787-806, 809, 810, 813, 814, 817-832, 835-840, 845, 846, 851-890, 895, 896, 901, 902, 905-916, 919-922, 925-3076, 3081-3252, 3257-3376, 3379-3468, 3471-3546, 3551-3560, and 3563-4531, and
      wherein the transfer agent conditions the surface of the plant for permeation by the at least one non-transcribable polynucleotide, and
   (b) applying the ACCase inhibitor herbicide to the plant; whereby the at least one non-transcribable polynucleotide permeates the interior of the plant and induces suppression of an ACCase gene, thereby potentiating activity of the ACCase inhibitor herbicide in the plant.

2. The method of claim 1, wherein
   the at least one non-transcribable polynucleotide is selected from the group consisting of a sense single-stranded DNA (ssDNA), an anti-sense ssDNA, a sense single-stranded RNA (ssRNA), an anti-sense ssRNA, a double-stranded RNA (dsRNA), a double-stranded DNA (dsDNA), and a dsDNA/RNA hybrid; or
   the composition comprises two or more of the at least one non-transcribable polynucleotides.

3. The method of claim 1, wherein the transfer agent is an organosilicone surfactant composition or an organosilicone compound contained therein.

4. The method of claim 1, wherein the composition further comprises the ACCase inhibitor herbicide.

5. The method of claim 4, wherein the ACCase inhibitor herbicide is selected from the group consisting of aryloxyphenoxypropionates, cyclohexanediones, and phenylpyrazoline.

6. The method of claim 4, wherein the composition further comprises one or more herbicides different from the ACCase inhibitor herbicide.

7. The method of claim 4, wherein the composition further comprises a co-herbicide.

8. The method of claim 7, wherein the co-herbicide is selected from the group consisting of amide herbicides, arsenical herbicides, benzothiazole herbicides, benzoylcyclohexanedione herbicides, benzofuranyl alkylsulfonate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, glycine herbicides, halogenated aliphatic herbicides, imidamlinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides.

9. The method of claim 4, wherein the composition further comprises a pesticide.

10. The method of claim 9, wherein the pesticide is selected from the group consisting of insecticides, fungicides, nematicides, bactericides, acaricides, growth regulators, chemosterilants, semiochemicals, repellents, attractants, pheromones, feeding stimulants, and biopesticides.

11. The method of claim 1, wherein the plant is selected from the group consisting of *Amaranthus palmeri, Amaranthus rudis, Amaranthsu chlorostachys, Amaranthus thunbergii, Amaranthus graecizans, Amaranthus hybridus, Amaranthus lividus, Amaranthus spinosus, Abutilon theophrasti, Ambrosia trifida, Commelina diffusa, Conyza canadensis, Lolium multiflorum, Sorghum halepense, Xanthium strumarium, Euphorbia heterophylla, Kochia scoparia,* and *Digitaria sanguinalis.*

12. A method of reducing growth, development, or reproductive ability in a plant, comprising
treating a plant with an ACCase inhibitor herbicide in combination with
(a) at least one non-transcribable polynucleotide that is from 21 to about 700 nucleotides in length and is identical or complementary to at least 21 contiguous nucleotides of an ACCase gene sequence or an RNA sequence thereof, wherein the ACCase gene sequence is selected from the group consisting of SEQ ID NOs: 1, 5, 6, 11, 12, 16-18, 22-24, 26, 27, 32, 34-74, 79, 81-104, 109-116, 121-132, 135, 136, 139-150, 153-166, 171-180, 183-186, 189-326, 337-344, 347-360, 363-366, 369, 370, 373, 374, 377-380, 383-414, 425-432, 435-448, 451-454, 457, 458, 461, 462, 465-556, 567-572, 575-596, 601, 602, 607, 608, 611, 612, 615-618, 621, 622, 625-628, 631-694, 701-704, 707, 708, 711-722, 725-750, 753, 754, 757-768, 773, 774, 779-784, 787-806, 809, 810, 813, 814, 817-832, 835-840, 845, 846, 851-890, 895, 896, 901, 902, 905-916, 919-922, 925-3076, 3081-3252, 3257-3376, 3379-3468, 3471-3546, 3551-3560, and 3563-4531, and
(b) an organosilicone surfactant,
whereby growth, development, or reproductive ability is reduced in the treated plant compared to a control plant treated with the ACCase inhibitor herbicide alone.

13. The method of claim 12, wherein
the at least one non-transcribable polynucleotide is selected from the group consisting of a sense ssDNA, an anti-sense ssDNA, a sense ssRNA, an anti-sense ssRNA, a dsRNA, a dsDNA, and a dsDNA/RNA hybrid; or
the composition comprises two or more of the at least one non-transcribable polynucleotides.

14. The method of claim 12, wherein the ACCase inhibitor herbicide is selected from the group consisting of aryloxyphenoxypropionates, cyclohexanediones, and phenylpyrazoline.

15. The method of claim 12, wherein the composition further comprises a co-herbicide or a pesticide.

16. The method of claim 12, wherein the plant is selected from the group consisting of *Amaranthus palmeri, Amaranthus rudis, Amaranthsu chlorostachys, Amaranthus thunbergii, Amaranthus graecizans, Amaranthus hybridus, Amaranthus lividus, Amaranthus spinosus, Abutilon theophrasti, Ambrosia trifida, Commelina diffusa, Conyza canadensis, Lolium multiflorum, Sorghum halepense, Xanthium strumarium, Euphorbia heterophylla, Kochia scoparia,* and *Digitaria sanguinalis.*

17. The method of claim 1, wherein the at least one non-transcribable polynucleotide is at least 22 nucleotides in length.

18. The method of claim 1, wherein the at least one non-transcribable polynucleotide is at least 23 nucleotides in length.

19. The method of claim 1, wherein the ACCase gene sequence is selected from the group consisting of 1, 5, 6, 26, 27, 32, 47, 61, 65, 92-104, 109-116, 123-132, 135, 136, 139-150, 153-166, 171-180, 183-186, 189, 190, 291-304, 307-320, 323, 324, 337, 338, 341-344, 347-350, 355-360, 363-366, 369, 370, 373, 374, 377-380, 383, 384, 389-394, 413, 414, 425-432, 435-448, 451-454, 457, 458, 461, 462, 465-472, 533-536, 541-556, 569-572, 583, 584, 587-596, 601, 602, 607, 608, 611, 612, 615-618, 621, 622, 625-628, 631, 632, 657-662, 665, 666, 679-694, 701-704, 707, 708, 711-722, 725-734, 737, 738, 753, 754, 757-762, 765-768, 773, 774, 779-784, 787, 788, 805, 806, 809, 810, 813, 814, 817-832, 835-840, 845, 846, 851-890, 895, 896, 901, 902, 905-916, 919-922, 925-928, 1675-1720, 1755-1798, 2001, 2002, 2011, 2012, 2021, 2022, 2031-2054, 2057, 2058, 2077-2130, 2297, 2298, 2307-2328, 2333, 2334, 2365-2370, 2441-2458, 2667, 2668, 2695-2708, 2751-2758, 2799-2804, 2807-2812, 2929-2942, and 3867-4531.

20. The method of claim 1, wherein the applying the ACCase inhibitor herbicide to the plant of step (b) is at least one day after the applying to the surface of the plant the composition of step (a).

* * * * *